US012508325B2

(12) United States Patent
Walter et al.

(10) Patent No.: US 12,508,325 B2
(45) Date of Patent: Dec. 30, 2025

(54) COMPOSITIONS AND METHODS FOR REPROGRAMMING DISEASED MUSCULOSKELETAL CELLS

(71) Applicants: Ohio State Innovation Foundation, Columbus, OH (US); UMIP The University of Manchester Intellectual Property, Manchester (GB)

(72) Inventors: Devina Walter, Columbus, OH (US); Shirley Tang, Groveport, OH (US); Judith Hoyland, Glossop (GB); Safdar Khan, Columbus, OH (US); Benjamin Walter, Columbus, OH (US); Daniel Gallego-Perez, Columbus, OH (US); Natalia Higuita-Castro, Columbus, OH (US)

(73) Assignees: Ohio State Innovation Foundation, Columbus, OH (US); UMIP The University of Manchester Intellectual Property, Manchester (GB)

( * ) Notice: Subject to any disclaimer, the term of this patent is extended or adjusted under 35 U.S.C. 154(b) by 1023 days.

(21) Appl. No.: 17/332,470

(22) PCT Filed: Dec. 19, 2019

(86) PCT No.: PCT/US2019/067448

§ 371 (c)(1),
(2) Date: May 27, 2021

(87) PCT Pub. No.: WO2020/132226

PCT Pub. Date: Jun. 25, 2020

(65) Prior Publication Data

US 2022/0118109 A1 Apr. 21, 2022

Related U.S. Application Data

(60) Provisional application No. 62/782,734, filed on Dec. 20, 2018.

(51) Int. Cl.

| | |
|---|---|
| ***A61K 48/00*** | (2006.01) |
| ***A61P 21/00*** | (2006.01) |
| ***A61P 21/02*** | (2006.01) |
| ***C07K 14/47*** | (2006.01) |
| ***C12N 15/85*** | (2006.01) |

(52) U.S. Cl.

CPC .......... *A61K 48/0025* (2013.01); *A61P 21/00* (2018.01); *C07K 14/4702* (2013.01); *C12N 15/85* (2013.01); *C12N 2800/107* (2013.01)

(58) Field of Classification Search

None

See application file for complete search history.

(56) References Cited

U.S. PATENT DOCUMENTS

| | | | | |
|---|---|---|---|---|
| 2007/0028314 A1* | 2/2007 | Komori | C07K 14/47 | 435/6.16 |
| 2009/0076481 A1 | 3/2009 | Stegmann et al. | | |
| 2013/0230454 A1* | 9/2013 | Gardner | A61K 49/06 | 424/9.4 |
| 2018/0273906 A1 | 9/2018 | Ashraf | | |

FOREIGN PATENT DOCUMENTS

| | | |
|---|---|---|
| WO | 2017167788 A1 | 10/2017 |
| WO | 2017/211906 A1 | 12/2017 |

OTHER PUBLICATIONS

Zhu et al,Can extracellular vesicles be considered as a potential frontier in the treatment of intervertebral disc disease?, Ageing Research Reviews, 2023, pp. 1-17.*

Oshchepkova, A.; Zenkova, M.; Vlassov, V. Extracellular Vesicles for Therapeutic Nucleic Acid Delivery: Loading Strategies and Challenges, 2023, pp. 1-34.*

Xia et al, Biomaterials delivery strategies to repair degenerated intervertebral discs by regulating the inflammatory microenvironment, 2023, pp. 1-18.*

National Academies of Sciences, Ch 5. Musculoskeletal Disorders, 2020, pp. 1-57.*

Matta and Erwin, Injectable Biologics for the Treatment of Degenerative Disc Disease, Current Reviews in Musculoskeletal Medicine (2020) 13:680-687.*

Distefano et al., Extracellular Vesicles as an Emerging Treatment Option for Intervertebral Disc Degeneration: Therapeutic otential, Translational Pathways, and Regulatory Considerations, Advanced Healthcare Materials, 2022, pp. 1-25.*

Tang et al, Nonviral Transfection With Brachyury Reprograms Human Intervertebral Disc Cells to a Pro-Anabolic Anti-Catabolic/Inflammatory Phenotype: A Proof of Concept Study, Journal of Orthopaedic Research, Nov. 2019, pp. 2389-2400.*

Czibik et al., Gene Therapy with Hypoxia-Inducible Factor 1 Alpha in Skeletal Muscle is Cardioprotective in Vivo, Life Sci., vol. 88, No. 11-12, 2011

Merceron et al., Loss of HIF-1 Alpha in the Notochord Results in Cell Death and Complete Disapperance of the Nucleus Pulposus PLoS, vol. 9, No. 10, p. 1-11, 2014.

* cited by examiner

*Primary Examiner* — Maria Marvich

(74) *Attorney, Agent, or Firm* — Pabst Patent Group LLP

(57) ABSTRACT

Disclosed herein are compositions and methods for reprogramming diseased musculoskeletal cells both in vitro and in vivo. In some embodiments, the disclosed method involves non-virally delivering intracellularly into the diseased musculoskeletal cells a polynucleotide comprising one or more nucleic acid sequences encoding one or more of the disclosed transcription factors.

7 Claims, 34 Drawing Sheets

Specification includes a Sequence Listing.

COMPOSITIONS AND METHODS FOR REPROGRAMMING DISEASED MUSCULOSKELETAL CELLS

CROSS-REFERENCE TO RELATED APPLICATIONS

This application is a National Stage of International Application No. PCT/US2019/067448, filed Dec. 19, 2019, which claims benefit of U.S. Provisional Application No. 62/782,734, filed Dec. 20, 2018, which is hereby incorporated herein by reference in its entirety.

SEQUENCE LISTING

This application contains a sequence listing filed in electronic form as an ASCII.txt file entitled "321501_2380_Sequence_Listing_ST25" created on Dec. 18, 2019. The content of the sequence listing is incorporated herein in its entirety.

BACKGROUND

Current therapies for musculoskeletal diseases, such as low back pain, are highly invasive and is a major contributor to the growing opioid crisis. Additionally, these therapies only treat the symptomatic pain of the patient while failing to target the underlying pathology of disease which leads to further disease progression and future pain. For example, lumbar fusion of the spine is a common surgical operation to fuse the spine in place of the intervertebral disc space between the vertebras. However, removal of the disc and fusion of the vertebrae often results in adjacent segment disease due to imbalanced biomechanics of the spine post-surgery. In addition, micro-discectomies which remove the diseased tissue from the site often lead to tissue collapse and additional surgical intervention with added pain. Therefore, new treatment methods of such diseases are needed to alleviate these issues.

Current studies in the field include engineered intervertebral discs, cell therapies, drug delivery, growth factors, viral reprogramming or gene editing. However, these all include their pitfalls and risks. Engineered constructs for replacement of musculoskeletal components are disadvantageous in their biocompatibility and most importantly mechanical integrity in the body environment to function effectively. Cell therapies are poor in terms of long-term cell viability due to the harsh avascular environment of tissues such as the intervertebral disc. Drug delivery systems are hard to sustain in the environment and has potential to leech onto nearby tissue with undesired effects similar to growth factors such as Bone morphogenic proteins (BMPs) and Tumor Growth Factor (TGFβ). Viral reprogramming and gene editing have large regulatory burdens as they often involve integration into the native host genome which has been shown in history to cause adverse immunogenic and mutagenic effects on the patients. The death of Jesse Gelsinger is one such example.

SUMMARY

Disclosed herein are compositions and methods for reprogramming diseased musculoskeletal cells both in vitro and in vivo.

In some embodiments, the disclosed method involves non-virally delivering intracellularly into the diseased musculoskeletal cells a polynucleotide comprising one or more nucleic acid sequences encoding one or more transcription factors, such as HIF-1α, FOX, T, SOX, and Mohawk families of transcription factors, including the factors listed in Tables 1A, 1B, and 1C.

For example, in some embodiments, the method involves reprogramming a diseased nucleus pulposus (NP) cell into a healthy cell by non-virally delivering intracellularly into the NP cell one or more transcription factor proteins selected from the group comprising HIF-1α, HIF-2α, Hedgehog family (SHH, DHH, IHH), a T-box family of proteins (TBXT, TBR1, TBX1-6, TBX10, TBX15, TX618-22), and a Forkhead-box (FOX) family of proteins (FOXF1, FOXA1-3, FOXB1-2, FOXC1-2, FOXD1-6, FOXE1-3, FOXG1, FOXH1, FOXI1, FOXJ1, FOXK1, FOXL1-2, FOXM1, FOXN1-4, FOXO1, FOXO3-4, FOXO6, FOXP1-4, FOXQ1, FOXR1-2), or polynucleotides encoding the one or more transcription factor proteins; or exposing the NP cell to an extracellular vesicle produced from a cell containing or expressing the one or more transcription factor proteins, or polynucleotides encoding the one or more transcription factor proteins.

In some embodiments, the method involves reprogramming a diseased annulus fibrosis (AF) cell into a healthy cell by non-virally delivering intracellularly into the AF cell one or more transcription factor proteins selected from the group comprising a Iroquois Homeobox family of proteins (Mohawk, IRX1-6), Tenomodulin and Scleraxis, or polynucleotides encoding the one or more transcription factor proteins; or exposing the AF cell to an extracellular vesicle produced from a cell containing or expressing the one or more transcription factor proteins, or polynucleotides encoding the one or more transcription factor proteins.

In some embodiments, the method involves reprogramming a diseased cartilage endplate cell into a healthy cell by non-virally delivering intracellularly into the cartilage endplate cell one or more transcription factor proteins selected from the group comprising an NFAT Family proteins (NFATc1-4), ERG (C-1-1), PGC1α, Osterix, SOX family of proteins (SRY, SOX1-15, SOX17-18, SOX21, SOX30) and MEF2C, or polynucleotides encoding the one or more transcription factor proteins; or exposing the cartilage endplate cell to an extracellular vesicle produced from a cell containing or expressing the one or more transcription factor proteins, or polynucleotides encoding the one or more transcription factor protein.

Also disclosed herein is a method for treating a musculoskeletal disease in a subject that involves non-virally delivering intracellularly into disease musculoskeletal cells of the subject one or more transcription factor proteins selected from the group comprising HIF-1α, HIF-2α, a T-box family protein, and Forkhead-box (FOX) family protein, a Iroquois family proteins, Tenomodulin, Scleraxis, NFAT Family proteins, ERG, PGC1α, Osterix, Runx family of proteins, Hedgehog family of proteins, SOX family of proteins and MEF2C, or polynucleotides encoding the one or more transcription factor proteins; or exposing the disease musculoskeletal cells to an extracellular vesicle produced from a cell containing or expressing the one or more transcription factor proteins, or polynucleotides encoding the one or more transcription factor proteins.

In some embodiments, the musculoskeletal disease is osteoarthritis where chondrocytes, synoviocytes, fibrocartilage cells of the meniscus, osteoblasts, osteocytes and osteoclasts will be subject to non-viral reprogramming. In some embodiments, the musculoskeletal disease is intervertebral disc degeneration and chronic low back pain where notochordal cells, nucleus pulposus cells, annulus fibrosus cells, cartilage endplate cells, ligamentous cells, dorsal root ganglion cells and myocytes/myofibroblasts will be subject to non-viral reprogramming or injection of engineered vesicles. In some embodiments, the musculoskeletal disease is tendinopathy or rotator cuff tendonitis where tenocytes and myocytes/myofibroblasts will be subject to non-viral reprogramming or injection of engineered vesicles.

In some embodiments, the disclosed methods involve non-viral tissue nanotransfection (TNT) of notochordal cells, nucleus pulposus (NP), annulus fibrosis (AF), or cartilage endplate cells of a subject's intervertebral disc (IVD) or chondrocytes, synoviocytes, fibrocartilage cells of the meniscus, ligamentous cells, dorsal root ganglion cells, osteoblasts, osteoclasts, osteocytes, myocytes/myofibroblasts, haemapoetic and mesenchymal stem cells or tenocytes. This can be done via direct tissue nanotransfection of the NP, AF, and CEP tissue with previously stated transcription factors during patient surgery, or on cells isolated from patients. More precisely, the tissue nanotransfection device chip will be placed at the site of the IVD where degeneration is occurring and transcription factors targeting the specific tissue will be delivered in-situ. More precisely, cells from the patient IVD can be isolated and transfected ex-vivo with transcription factors and injected back into the patient.

In some embodiments, the disclosed methods involve delivery of extracellular vesicles (EVs) to the notochordal cells, nucleus pulposus (NP), annulus fibrosis (AF), or cartilage endplate cells of a subject's intervertebral disc (IVD) or chondrocytes, synoviocytes, fibrocartilage cells of the meniscus, ligamentous cells, dorsal root ganglion cells, osteoblasts, osteoclasts, osteocytes, myocytes/myofibroblasts, or tenocytes. EVs will be generated using the patient's cells which encapsulates the desired transcription factors specific for each tissue. EVs containing these factors are then injected back into the diseased/degenerate tissue and up taken by the patients cells within 4-6 hours of cell-vector contact.

Also disclosed herein are polynucleotides comprising one, two, or more nucleic acid sequences encoding transcription factors disclosed herein, such as Forkhead-box (FOX) family protein, Iroquois I family proteins, Scleraxis, NFAT Family proteins, ERG, PGC1a, Osterix, and MEF2C. In some embodiments, the transcription factors are mammalian proteins, such as human proteins.

Also disclosed a composition comprising a polynucleotide comprising one, two, or more nucleic acid sequences encoding transcription factors disclosed herein. Also disclosed are non-viral vectors containing the disclosed polynucleotides. In particular embodiments, the vector is a recombinant bacterial plasmid. For example, in some embodiments, the non-viral vector has a pCDNA3 backbone. In some embodiments, the vector comprises an internal ribosome entry site (IRES).

In some embodiments, after transfecting target cells with nucleic acid sequences encoding the disclosed transcription factors, the cells can then pack the transfected genes (e.g. cDNA) into EVs, which can then reprogram diseased musculoskeletal cells. Therefore, also disclosed is a method of reprogramming diseased musculoskeletal cells that involves exposing the cells with an extracellular vesicle produced from a cell containing or expressing the disclosed transcription factors.

In these embodiments, the polynucleotides and compositions may be delivered to diseased musculoskeletal cells, or donor cells, intracellularly via a gene gun, a microparticle or nanoparticle suitable for such delivery, transfection by electroporation, three-dimensional nanochannel electroporation, a tissue nanotransfection device, a liposome suitable for such delivery, or a deep-topical tissue nanoelectroinjection device. In some of these embodiments, the polynucleotides can be incorporated into a non-viral vector, such as a bacterial plasmid. In some embodiments, a viral vector can be used. For example, the polynucleotides can be incorporated into a viral vector, such as an adenoviral vector. However, in other embodiments, the polynucleotides are not delivered virally.

The details of one or more embodiments of the invention are set forth in the accompanying drawings and the description below. Other features, objects, and advantages of the invention will be apparent from the description and drawings, and from the claims.

DESCRIPTION OF DRAWINGS

FIG. 3 is a graph showing qPCR Gene expression data validating that the transcription factor was successfully transmitted. X-axis=type of tissue and transcription factor. Colors indicate the gene being tested for.

FIG. 18A shows FOXF1 upregulation in transfected cells. FIG. 18B shows particle count of FOXF1- and PCMV6-loaded EVs. FIG. 18C shows FOXF1 levels in generated EVs.

FIG. 20 is a bar graph showing gene expression for FOXF1 and Brachyury.

DETAILED DESCRIPTION

Figure 1A:
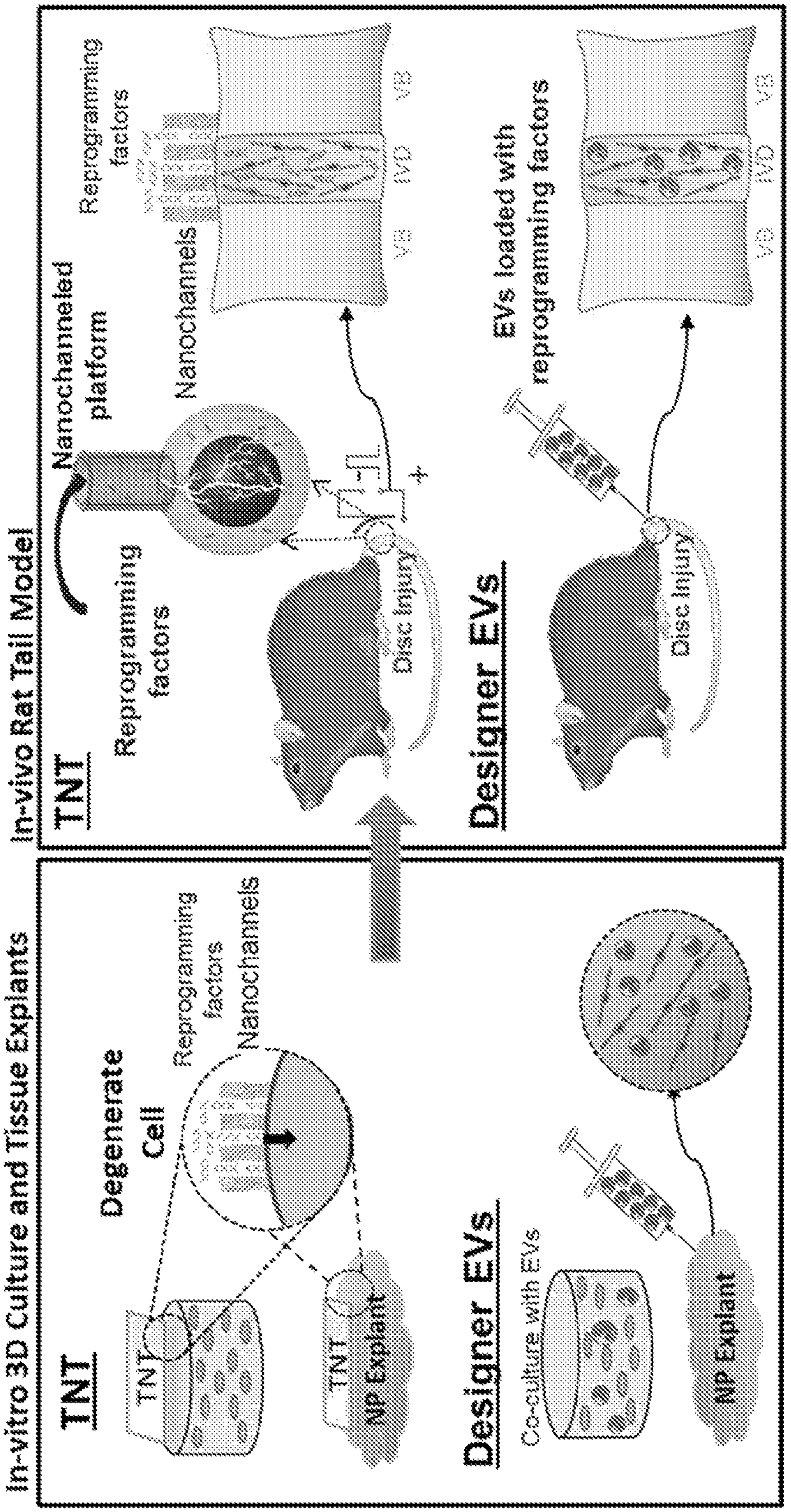
FIGS. 1A and 1B illustrate an embodiment the disclosed technology to use the combination of transcription factor and TNT/Evs to revert diseased intervertebral disc cells to a healthy phenotype. We have shown promising in-vitro cellular work, in-vivo rodent models, and have submitted grants to move to a large scale in-vivo canine model and larger animal trials in the future clinically relevant to the human condition. Remaining claims will focus on our current in-vitro and in-vivo work

Before the present disclosure is described in greater detail, it is to be understood that this disclosure is not limited to particular embodiments described, and as such may, of course, vary. It is also to be understood that the terminology used herein is for the purpose of describing particular embodiments only, and is not intended to be limiting, since the scope of the present disclosure will be limited only by the appended claims.

Where a range of values is provided, it is understood that each intervening value, to the tenth of the unit of the lower limit unless the context clearly dictates otherwise, between the upper and lower limit of that range and any other stated or intervening value in that stated range, is encompassed within the disclosure. The upper and lower limits of these smaller ranges may independently be included in the smaller ranges and are also encompassed within the disclosure, subject to any specifically excluded limit in the stated range. Where the stated range includes one or both of the limits, ranges excluding either or both of those included limits are also included in the disclosure.

Unless defined otherwise, all technical and scientific terms used herein have the same meaning as commonly understood by one of ordinary skill in the art to which this disclosure belongs. Although any methods and materials similar or equivalent to those described herein can also be used in the practice or testing of the present disclosure, the preferred methods and materials are now described.

All publications and patents cited in this specification are herein incorporated by reference as if each individual publication or patent were specifically and individually indicated to be incorporated by reference and are incorporated herein by reference to disclose and describe the methods and/or materials in connection with which the publications are cited. The citation of any publication is for its disclosure prior to the filing date and should not be construed as an admission that the present disclosure is not entitled to antedate such publication by virtue of prior disclosure. Further, the dates of publication provided could be different from the actual publication dates that may need to be independently confirmed.

As will be apparent to those of skill in the art upon reading this disclosure, each of the individual embodiments described and illustrated herein has discrete components and features which may be readily separated from or combined with the features of any of the other several embodiments without departing from the scope or spirit of the present disclosure. Any recited method can be carried out in the order of events recited or in any other order that is logically possible.

Embodiments of the present disclosure will employ, unless otherwise indicated, techniques of chemistry, biology, and the like, which are within the skill of the art.

The following examples are put forth so as to provide those of ordinary skill in the art with a complete disclosure and description of how to perform the methods and use the probes disclosed and claimed herein. Efforts have been made to ensure accuracy with respect to numbers (e.g., amounts, temperature, etc.), but some errors and deviations should be accounted for. Unless indicated otherwise, parts are parts by weight, temperature is in ° C., and pressure is at or near atmospheric. Standard temperature and pressure are defined as 20° C. and 1 atmosphere.

Before the embodiments of the present disclosure are described in detail, it is to be understood that, unless otherwise indicated, the present disclosure is not limited to particular materials, reagents, reaction materials, manufacturing processes, or the like, as such can vary. It is also to be understood that the terminology used herein is for purposes of describing particular embodiments only, and is not intended to be limiting. It is also possible in the present disclosure that steps can be executed in different sequence where this is logically possible.

It must be noted that, as used in the specification and the appended claims, the singular forms "a," "an," and "the" include plural referents unless the context clearly dictates otherwise.

The term "subject" refers to any individual who is the target of administration or treatment. The subject can be a vertebrate, for example, a mammal. Thus, the subject can be a human or veterinary patient. The term "patient" refers to a subject under the treatment of a clinician, e.g., physician or veterinarian.

The term "therapeutically effective" refers to the amount of the composition used is of sufficient quantity to ameliorate one or more causes or symptoms of a disease or disorder. Such amelioration only requires a reduction or alteration, not necessarily elimination.

The term "pharmaceutically acceptable" refers to those compounds, materials, compositions, and/or dosage forms which are, within the scope of sound medical judgment, suitable for use in contact with the tissues of human beings and animals without excessive toxicity, irritation, allergic response, or other problems or complications commensurate with a reasonable benefit/risk ratio.

The term "carrier" means a compound, composition, substance, or structure that, when in combination with a compound or composition, aids or facilitates preparation, storage, administration, delivery, effectiveness, selectivity, or any other feature of the compound or composition for its intended use or purpose. For example, a carrier can be selected to minimize any degradation of the active ingredient and to minimize any adverse side effects in the subject.

The term "treatment" refers to the medical management of a patient with the intent to cure, ameliorate, stabilize, or prevent a disease, pathological condition, or disorder. This term includes active treatment, that is, treatment directed specifically toward the improvement of a disease, pathological condition, or disorder, and also includes causal treatment, that is, treatment directed toward removal of the cause of the associated disease, pathological condition, or disorder. In addition, this term includes palliative treatment, that is, treatment designed for the relief of symptoms rather than the curing of the disease, pathological condition, or disorder; preventative treatment, that is, treatment directed to minimizing or partially or completely inhibiting the development of the associated disease, pathological condition, or disorder; and supportive treatment, that is, treatment employed to supplement another specific therapy directed toward the improvement of the associated disease, pathological condition, or disorder.

The term "inhibit" refers to a decrease in an activity, response, condition, disease, or other biological parameter. This can include but is not limited to the complete ablation of the activity, response, condition, or disease. This may also include, for example, a 10% reduction in the activity, response, condition, or disease as compared to the native or control level. Thus, the reduction can be a 10, 20, 30, 40, 50, 60, 70, 80, 90, 100%, or any amount of reduction in between as compared to native or control levels.

The term "polypeptide" refers to amino acids joined to each other by peptide bonds or modified peptide bonds, e.g., peptide isosteres, etc. and may contain modified amino acids other than the 20 gene-encoded amino acids. The polypeptides can be modified by either natural processes, such as post-translational processing, or by chemical modification techniques which are well known in the art. Modifications can occur anywhere in the polypeptide, including the peptide backbone, the amino acid side-chains and the amino or carboxyl termini. The same type of modification can be present in the same or varying degrees at several sites in a given polypeptide. Also, a given polypeptide can have many types of modifications. Modifications include, without limitation, acetylation, acylation, ADP-ribosylation, amidation, covalent cross-linking or cyclization, covalent attachment of flavin, covalent attachment of a heme moiety, covalent attachment of a nucleotide or nucleotide derivative, covalent attachment of a lipid or lipid derivative, covalent attachment of a phosphytidylinositol, disulfide bond formation, demethylation, formation of cysteine or pyroglutamate, formylation, gamma-carboxylation, glycosylation, GPI anchor formation, hydroxylation, iodination, methylation, myristolyation, oxidation, pergylation, proteolytic processing, phosphorylation, prenylation, racemization, selenoylation, sulfation, and transfer-RNA mediated addition of amino acids to protein such as arginylation. (See Proteins—Structure and Molecular Properties 2nd Ed., T. E. Creighton, W. H. Freeman and Company, New York (1993); Posttranslational Covalent Modification of Proteins, B. C. Johnson, Ed., Academic Press, New York, pp. 1-12 (1983)).

As used herein, the term "amino acid sequence" refers to a list of abbreviations, letters, characters or words representing amino acid residues. The amino acid abbreviations used herein are conventional one letter codes for the amino acids and are expressed as follows: A, alanine; B, asparagine or aspartic acid; C, cysteine; D aspartic acid; E, glutamate, glutamic acid; F, phenylalanine; G, glycine; H histidine; I isoleucine; K, lysine; L, leucine; M, methionine; N, asparagine; P, proline; Q, glutamine; R, arginine; S, serine; T, threonine; V, valine; W, tryptophan; Y, tyrosine; Z, glutamine or glutamic acid.

The phrase "nucleic acid" as used herein refers to a naturally occurring or synthetic oligonucleotide or polynucleotide, whether DNA or RNA or DNA-RNA hybrid, single-stranded or double-stranded, sense or antisense, which is capable of hybridization to a complementary nucleic acid by Watson-Crick base-pairing. Nucleic acids can also include nucleotide analogs (e.g., BrdU), and non-phosphodiester internucleoside linkages (e.g., peptide nucleic acid (PNA) or thiodiester linkages). In particular, nucleic acids can include, without limitation, DNA, RNA, cDNA, gDNA, ssDNA, dsDNA or any combination thereof.

A "nucleotide" as used herein is a molecule that contains a base moiety, a sugar moiety, and a phosphate moiety. Nucleotides can be linked together through their phosphate moieties and sugar moieties creating an internucleoside linkage. The term "oligonucleotide" is sometimes used to refer to a molecule that contains two or more nucleotides linked together. The base moiety of a nucleotide can be adenine-9-yl (A), cytosine-1-yl (C), guanine-9-yl (G), uracil-1-yl (U), and thymin-1-yl (T). The sugar moiety of a nucleotide is a ribose or a deoxyribose. The phosphate moiety of a nucleotide is pentavalent phosphate. A non-limiting example of a nucleotide would be 3'-AMP (3'-adenosine monophosphate) or 5'-GMP (5'-guanosine monophosphate).

A nucleotide analog is a nucleotide that contains some type of modification to the base, sugar, and/or phosphate moieties. Modifications to nucleotides are well known in the art and would include, for example, 5-methylcytosine (5-me-C), 5 hydroxymethyl cytosine, xanthine, hypoxanthine, and 2-aminoadenine as well as modifications at the sugar or phosphate moieties.

Nucleotide substitutes are molecules having similar functional properties to nucleotides, but which do not contain a phosphate moiety, such as peptide nucleic acid (PNA). Nucleotide substitutes are molecules that will recognize nucleic acids in a Watson-Crick or Hoogsteen manner, but are linked together through a moiety other than a phosphate moiety. Nucleotide substitutes are able to conform to a double helix type structure when interacting with the appropriate target nucleic acid.

The term "vector" or "construct" refers to a nucleic acid sequence capable of transporting into a cell another nucleic acid to which the vector sequence has been linked. The term "expression vector" includes any vector, (e.g., a plasmid, cosmid or phage chromosome) containing a gene construct in a form suitable for expression by a cell (e.g., linked to a transcriptional control element). "Plasmid" and "vector" are used interchangeably, as a plasmid is a commonly used form of vector. Moreover, the invention is intended to include other vectors which serve equivalent functions.

The term "operably linked to" refers to the functional relationship of a nucleic acid with another nucleic acid sequence. Promoters, enhancers, transcriptional and translational stop sites, and other signal sequences are examples of nucleic acid sequences operably linked to other sequences. For example, operable linkage of DNA to a transcriptional control element refers to the physical and functional relationship between the DNA and promoter such that the transcription of such DNA is initiated from the promoter by an RNA polymerase that specifically recognizes, binds to and transcribes the DNA.

For purposes herein, the % sequence identity of a given nucleotides or amino acids sequence C to, with, or against a given nucleic acid sequence D (which can alternatively be phrased as a given sequence C that has or comprises a certain % sequence identity to, with, or against a given sequence D) is calculated as follows:

100 times the fraction W/Z, where W is the number of nucleotides or amino acids scored as identical matches by the sequence alignment program in that program's alignment of C and D, and where Z is the total number of nucleotides or amino acids in D. It will be appreciated that where the length of sequence C is not equal to the length of sequence D, the % sequence identity of C to D will not equal the % sequence identity of D to C. Alignment for purposes of determining percent sequence identity can be achieved in various ways that are within the skill in the art, for instance, using publicly available computer software such as BLAST, BLAST-2, ALIGN, ALIGN-2 or Megalign (DNASTAR) software.

By "specifically hybridizes" is meant that a probe, primer, or oligonucleotide recognizes and physically interacts (that is, base-pairs) with a substantially complementary nucleic acid (for example, a c-met nucleic acid) under high stringency conditions, and does not substantially base pair with other nucleic acids.

The term "stringent hybridization conditions" as used herein mean that hybridization will generally occur if there is at least 95% and preferably at least 97% sequence identity between the probe and the target sequence. Examples of stringent hybridization conditions are overnight incubation in a solution comprising 50% formamide, 5×SSC (150 mM NaCl, 15 mM trisodium citrate), 50 mM sodium phosphate (pH 7.6), 5×Denhardt's solution, 10% dextran sulfate, and 20 μg/ml denatured, sheared carrier DNA such as salmon sperm DNA, followed by washing the hybridization support in 0.1×SSC at approximately 65° C. Other hybridization and wash conditions are well known and are exemplified in Sambrook et al, Molecular Cloning: A Laboratory Manual, Second Edition, Cold Spring Harbor, N.Y. (1989), particularly chapter 11.

Compositions

Disclosed are polynucleotides comprising nucleic acid sequences encoding transcription factors that can be used to reprogram diseased musculoskeletal cells according to the disclosed methods. Examples of these transcription factors are provided in Tables 1A, 1B, 1C, 1D, 1E, 1F, 1G, and 1H.

TABLE 1A

Notochordal and Nucleus Pulposus (NP) Transcription Factors

| Transcription Factors | Description/Relevance to NP |
|---|---|
| HIF-1α/2α | hypoxia-inducible factor-1α:<br>"Transactivate many pro-survival genes in NP; absolutely necessary for postnatal NP cell survival"<br>Strong driver of glycolytic metabolism in the avascular IVD environment<br>upregulates: GLUT1/3, GAPDH, Aggrecan, B-1, 3-glucuronyltransferase 1, galectin-3<br>Suppresses expression of: ANK (pyrophosphate transporter)<br>Mice model of HIF-1 knockout has been shown to promote cell death with fibrous NP<br>involved in pathogenesis of OA |
| Shh (Wnt Shh signaling) pathways) | Sonic hedgehog:<br>"Signaling ligand necessary for postnatal function of NP cells"<br>Increases expression of Brachyury T and aggrecan<br>Member of the hedgehog family including DHH and IHH |
| T Family (Brachyury, etc) | T-box Family transcription factor:<br>"Transcription factor necessary for notochordal morphogenesis and patterning" |
| PAX1 | Paired Box Protein 1 |
| FOX Family (FOXF1, FOXA1, A2, ect) | Critical to formation of Intervertebral disc NP |
| SOX Family (SOX9, SOX5, SOX6, etc.) | Chondrogenic markers:<br>SOX9 shown to increase expression of COLII post adenoviral transfection in NP tissue.<br>SOX5 and SOX6 have been shown to be critical in ECM sheath formation, notochord cell survival, and nucleus pulposus formation |
| NOTO | Notochord Homeobox<br>regulates notochord development (precursor to NP) |

TABLE 1B

Annulus Fibrosus Transcription Factors

| Transcription Factors | Description/Relevance to AF |
|---|---|
| Mohawk Family | Homeobox protein:<br>Key transcription factor regulating AF development shown in humans and mice |
| Scleraxis | Part of basic helix-loop-helix (bHLH) super family required in musculoskeletal tissue maturation such as AF, ligaments, and tendons. |
| Tenomodulin | highly expressed in AF cells compared to NP Cells |
| PAX9 | Paired Box gene 9 |

TABLE 1C

Cartilage Endplate/Articular Cartilage Transcription Factors

| Transcription Factors | Description/Relevance to CEP |
|---|---|
| NFAT Family (Nfat1, ect) | Nucleated factor of activate T-Cells Family:<br>Nfat1 deficiency causes OA |
| C-1-1 | ets transcription factor:<br>involved in AC development<br>Note: Runx2 expression has been known to affect C-1-1 vs versa |
| PGC1α | regulates chondrogenesis with SOX9 |
| Osterix | required for calcification and degradation of cartilage matrixes (More for bone formation) |
| MEF2C | MEF2C is regulated by SOX9 in positive feedback loop<br>Prevents hypertrophy<br>stabilizes chondrogenic phenotype |
| SOX Family | important for chondrocyte phenotype |
| Nkx3-2 | Maintains sox9 expression |

TABLE 1D

| Osteocytes, Osteoclasts, Osteoblast Transcription Factors | |
|---|---|
| Transcription Factors | Description/Relevance to Osteocytes, Osteoclasts, Osteoblasts |
| RUNX2 | Runt-related transcription factor 2 for osteoblast differentiation |
| Foxc1 | Associated with endochondral ossification and osteoblast differentiation |
| AP1 Complex (Fos, FosB, Fra1, Fra2, Jun, JunB, JunD) | Responsible for cell proliferation, differentiation, apoptosis, ect and essential roles bone development |
| Zfp36 | Regulates HSP70 family proteins to protect against Osteoarthritis |
| Ebf1, Ebf3 | Regulates osteoblast and adipocyte lineages |
| Maf | Promotes age-associated osteoblast differentiation |
| Mef2c | Controls chondrocyte hypertrophy and bone development |
| Nupr1 | Increase bone volume |
| Twist1/2, Dermo-1 | Malfunctions in these genes cause inhibitory effects on osteoblast proliferation/differentiation |
| Maged1 | Overexpression in bone |
| Satb2 | Regulates osteoblast differentiation |
| LMP-3 | Induces osteogenic differentiation of fibroblasts |
| Oct3/4, Sox2, Klf4, c-Myc | Yamanaka factor |
| Osterix (Sp7) | Main Osteoblast-specific transcription factor |
| Dlx3, Dlx5, Dlx6 | Co-activates RUNX2 |
| C/EBPs, ATF4 | Lack of transcription factor in-vivo mice results in delayed skeletal development and decreased bone formation |
| NFATc | Bone deficiency in absence of gene and involved in chondrogenesis |
| Smads | Part of TGF-B/BMP signal transduction pathway |
| Menin | Enhances Runx2 transcriptional activity |
| Msx1, Msx2 | Important roles in skeletal development |
| NF-1 | Osteoclast differentiation |
| Krox20 and SP3 | Involved in endochondral ossification and osteoblast differentiation |
| Ob-1 | Highly expressed during osteoblast differentiation |

TABLE 1E

| Tenocyte and Ligament Transcription Factors | |
|---|---|
| Transcription Factors | Description/Relevance to Tenocyte/Tendon and Ligaments |
| Egr1,2 | Tendon development, healing, and differentiation |
| Scleraxis, Mkx | Generation of tendon progenitors |
| Six1/2, Eya1/2 | Muscle transcription factors involved in tendon regeneration |
| Pea3 | Induces scleraxis expression |
| Mohawk | Crucial for tendon/ligament homeostasis |

TABLE 1F

| Synoviocyte Transcription Factors | |
|---|---|
| Transcription Factors | Description/Relevance to Synoviocytes/Synovium |
| SOX4, 5, 11 | Promotes migration and invasion of synoviocytes |
| NFAT5 | Regulation of proinflammatory genes |
| BCL-6 | Master Transcription factor involved in immunity |
| HIF-1α, 2α | Synoviocyte differentiation |

TABLE 1G

| Monocytes and Myofibroblasts | |
|---|---|
| Transcription Factors | Description/Relevance to Monocytes and Myofibroblasts |
| MyoD | Myoblast determination protein |
| Myf5 | Key role in regulation of myogenesis |
| Myogenin | Induction of myogenesis |
| PU.1 | Important for macrophage and monocyte development |
| M-CSFR Pathway Regulatios | Important for monocyte development |
| C/EBPα | Directs monocyte differentiation |
| SRF | Critical for myofibroblast activation |
| GLI2 | Profibrotic secretion factor |

TABLE 1H

| Dorsal Root Ganglion Transcription Factors | |
|---|---|
| Transcription Factors | Description/Relevance to DRG |
| FoxO | Upregualated in uninjured rodent DRG model |
| Sp4 | Predominantly expressed in neurons |
| ATF2, 3 | Potential regeneration and downregulated in injured DRG |
| Etv4, Etv5 | Expressed in DRG development |
| Sox11 | Promotes nerve regeneration |
| Rest | Repressor element 1—silencing transcription factors regulators neuron remodeling |
| Runx1, 3 | Axonal Growth |

The amino acid and nucleic acid sequences encoding Forkhead-box (FOX) family proteins, a Mohawk family proteins, Scleraxis, NFAT Family proteins, C-1-1, PGC1α, Osterix, and MEF2C are known in the art.

In some embodiments, Forkhead box F1 (FOXF1) comprises the amino acid sequence:

```
                                   (SEQ ID NO: 1; NP_001442.2)
MSSAPEKQQPPHGGGGGGGGGGGAAMDPASSGPSKAKKTNAGIRRPEKPP

YSYIALIVMAIQSSPTKRLTLSEIYQFLQSRFPFFRGSYQGWKNSVRHNL

SLNECFIKLPKGLGRPGKGHYWTIDPASEFMFEEGSFRRRPRGFRRKCQA

LKPMYSMMNGLGFNHLPDTYGFQGSAGGLSCPPNSLALEGGLGMMNGHLP

GNVDGMALPSHSVPHLPSNGGHSYMGGCGGAAAGEYPHHDSSVPASPLLP

TGAGGVMEPHAVYSGSAAAWPPSASAALNSGASYIKQQPLSPCNPAANPL

SGSLSTHSLEQPYLHQNSHNAPAELQGIPRYHSQSPSMCDRKEFVFSFNA

MASSSMHSAGGGSYYHQQVTYQDIKPCVM,
```

or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:1).

In some embodiments, the nucleic acid sequence encoding FOXF1 comprises the nucleic acid sequence:

```
                                      (SEQ ID NO: 2; NM_001451)
ATGTCTTCGGCGCCCGAGAAGCAGCAGCCACCGCACGGCGGCGGCGGCGG

CGGCGGCGGGGGAGGCGGCGCGGCCATGGACCCCGCGTCGTCCGGCCCGT

CCAAGGCCAAGAAGACCAACGCCGGCATCCGGCGCCCGGAGAAGCCGCCC
```

-continued

TATTCCTACATCGCGCTCATCGTCATGGCCATCCAGAGTTCACCCACCAA

GCGCCTGACGCTGAGCGAGATCTACCAGTTCCTGCAGAGCCGCTTCCCCT

TCTTCCGGGGCTCCTACCAGGGCTGGAAGAACTCCGTGCGCCACAACCTC

TCGCTCAACGAGTGCTTCATCAAGCTACCCAAGGGCCTTGGGCGGCCCGG

CAAGGGCCACTACTGGACCATCGACCCGGCCAGCGAGTTCATGTTCGAGG

AGGGCTCCTTTCGGCGGCGGCCGCGCGGCTTCCGAAGGAAATGCCAGGCG

CTCAAGCCCATGTACAGCATGATGAACGGGCTCGGCTTCAACCACCTCCC

GGACACCTACGGCTTCCAGGGCTCGGCCGGCGGCCTCTCGTGCCCGCCCA

ACAGCCTGGCGCTGGAGGGCGGCCTGGGCATGATGAACGGCCACTTGCCG

GGCAACGTGGACGGCATGGCCCTGCCCAGCCACTCGGTGCCCCACCTGCC

TTCCAACGGCGGCCACTCGTACATGGGCGGCTGCGGCGGCGCGGCGGCCG

GCGAGTACCCGCACCACGACAGCTCGGTGCCCGCCTCCCCGCTGCTGCCC

ACCGGCGCCGGTGGGGTCATGGAGCCGCACGCCGTCTACTCGGGCTCGGC

GGCGGCCTGGCCGCCCTCGGCGTCCGCGGCGCTCAACAGCGGCGCCTCTT

ATATCAAGCAGCAGCCCCTGTCCCCCTGTAACCCCGCGGCCAACCCCCTG

TCCGGCAGCCTCTCCACGCACTCCCTGGAGCAGCCGTATCTGCACCAGAA

CAGCCACAACGCCCCAGCCGAGCTGCAAGGCATCCCGCGGTATCACTCGC

AGTCGCCCAGCATGTGTGACCGAAAGGAGTTTGTCTTCTCTTTCAACGCC

ATGGCGTCCTCTTCCATGCACTCGGCCGGCGGGGGCTCCTACTACCACCA

GCAGGTCACCTACCAAGACATCAAGCCTTGCGTGATG, or a nucleic acid sequence that hybridizes to a nucleic acid sequence consisting of SEQ ID NO:2 under stringent hybridization conditions.

In some embodiments, Forkhead Box A1 (FOXA1) comprises the amino acid sequence (SEQ ID NO: 3; NP_004487)

MLGTVKMEGHETSDWNSYYADTQEAYSSVPVSNMNSGLGSMNSMNTYMTM

NTMTTSGNMTPASFNMSYANPGLGAGLSPGAVAGMPGGSAGAMNSMTAAG

VTAMGTALSPSGMGAMGAQQAASMNGLGPYAAAMNPCMSPMAYAPSNLGR

SRAGGGGDAKTFKRSYPHAKPPYSYISLITMAIQQAPSKMLTLSEIYQWI

MDLFPYYRQNQQRWQNSIRHSLSFNDCFVKVARSPDKPGKGSYVVTLHPD

SGNMFENGCYLRRQKRFKCEKQPGAGGGGGSGSGGSGAKGGPESRKDPSG

ASNPSADSPLHRGVHGKTGQLEGAPAPGPAASPQTLDHSGATATGGASEL

KTPASSTAPPISSGPGALASVPASHPAHGLAPHESQLHLKGDPHYSFNHP

FSINNLMSSSEQQHKLDFKAYEQALQYSPYGSTLPASLPLGSASVTTRSP

IEPSALEPAYYQGVYSRPVLNTS, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:3.

In some embodiments, the nucleic acid sequence encoding FOXA1 comprises the nucleic acid sequence (SEQ ID NO: 4; NM_004496)

ATGTTAGGAACTGTGAAGATGGAAGGGCATGAAACCAGCGACTGGAACAG

CTACTACGCAGACACGCAGGAGGCCTACTCCTCCGTCCCGGTCAGCAACA

TGAACTCAGGCCTGGGCTCCATGAACTCCATGAACACCTACATGACCATG

AACACCATGACTACGAGCGGCAACATGACCCCGGCGTCCTTCAACATGTC

CTATGCCAACCCGGGCCTAGGGGCCGGCCTGAGTCCCGGCGCAGTAGCCG

GCATGCCGGGGGGCTCGGCGGGCGCCATGAACAGCATGACTGCGGCCGGC

GTGACGGCCATGGGTACGGCGCTGAGCCCGAGCGGCATGGGCGCCATGGG

TGCGCAGCAGGCGGCCTCCATGAATGGCCTGGGCCCCTACGCGGCCGCCA

TGAACCCGTGCATGAGCCCCATGGCGTACGCGCCGTCCAACCTGGGCCGC

AGCCGCGCGGGCGGCGGCGGCGACGCCAAGACGTTCAAGCGCAGCTACCC

GCACGCCAAGCCGCCCTACTCGTACATCTCGCTCATCACCATGGCCATCC

AGCAGGCGCCCAGCAAGATGCTCACGCTGAGCGAGATCTACCAGTGGATC

ATGGACCTCTTCCCCTATTACCGGCAGAACCAGCAGCGCTGGCAGAACTC

CATCCGCCACTCGCTGTCCTTCAATGACTGCTTCGTCAAGGTGGCACGCT

CCCCGGACAAGCCGGGCAAGGGCTCCTACTGGACGCTGCACCCGGACTCC

GGCAACATGTTCGAGAACGGCTGCTACTTGCGCCGCCAGAAGCGCTTCAA

GTGCGAGAAGCAGCCGGGGGCCGGCGGCGGGGGCGGGAGCGGAAGCGGGG

GCAGCGGCGCCAAGGGCGGCCCTGAGAGCCGCAAGGACCCCTCTGGCGCC

TCTAACCCCAGCGCCGACTCGCCCCTCCATCGGGGTGTGCACGGGAAGAC

CGGCCAGCTAGAGGGCGCGCCGGCCCCCGGGCCCGCCGCCAGCCCCCAGA

CTCTGGACCACAGTGGGGCGACGGCGACAGGGGGCGCCTCGGAGTTGAAG

ACTCCAGCCTCCTCAACTGCGCCCCCCATAAGCTCCGGGCCCGGGGCGCT

GGCCTCTGTGCCCGCCTCTCACCCGGCACACGGCTTGGCACCCCACGAGT

CCCAGCTGCACCTGAAAGGGGACCCCCACTACTCCTTCAACCACCCGTTC

TCCATCAACAACCTCATGTCCTCCTCGGAGCAGCAGCATAAGCTGGACTT

CAAGGCATACGAACAGGCACTGCAATACTCGCCTTACGGCTCTACGTTGC

CCGCCAGCCTGCCTCTAGGCAGCGCCTCGGTGACCACCAGGAGCCCCATC

GAGCCCTCAGCCCTGGAGCCGGCGTACTACCAAGGTGTGTATTCCAGACC

CGTCCTAAACACTTCC, or a nucleic acid sequence that hybridizes to a nucleic acid sequence consisting of SEQ ID NO:4 under stringent hybridization conditions.

In some embodiments, Forkhead box A2 (FOXA2) comprises the amino acid sequence (SEQ ID NO: 5; NP_710141)

MLGAVKMEGHEPSDWSSYYAEPEGYSSVSNMNAGLGMNGMNTYMSMSAAA

MGSGSGNMSAGSMNMSSYVGAGMSPSLAGMSPGAGAMAGMGGSAGAAGVA

GMGPHLSPSLSPLGGQAAGAMGGLAPYANMNSMSPMYGQAGLSRARDPKT

YRRSYTHAKPPYSYISLITMAIQQSPNKMLTLSEIYQWIMDLFPFYRQNQ

QRWQNSIRHSLSFNDCFLKVPRSPDKPGKGSFVVTLHPDSGNMFENGCYL

-continued

```
RRQKRFKCEKQLALKEAAGAAGSGKKAAAGAQASQAQLGEAAGPASETPA

GTESPHSSASPCQEHKRGGLGELKGTPAAALSPPEPAPSPGQQQQAAAHL

LGPPHHPGLPPEAHLKPEHHYAFNHPFSINNLMSSEQQHHHSHHHHQPHK

MDLKAYEQVMHYPGYGSPMPGSLAMGPVTNKTGLDASPLAADTSYYQGVY

SRPIMNSS,
```

or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:5.

In some embodiments, the nucleic acid sequence encoding FOXA2 comprises the nucleic acid sequence:

```
                                   (SEQ ID NO: 6; NM_153675)
ATGCTGGGAGCGGTGAAGATGGAAGGGCACGAGCCGTCCGACTGGAGCAG

CTACTATGCAGAGCCCGAGGGCTACTCCTCCGTGAGCAACATGAACGCCG

GCCTGGGGATGAACGGCATGAACACGTACATGAGCATGTCGGCGGCCGCC

ATGGGCAGCGGCTCGGGCAACATGAGCGCGGGCTCCATGAACATGTCGTC

GTACGTGGGCGCTGGCATGAGCCCGTCCCTGGCGGGGATGTCCCCCGGCG

CGGGCGCCATGGCGGGCATGGGCGGCTCGGCCGGGGCGGCTGGCGTGGCG

GGCATGGGGCCGCACTTGAGTCCCAGCCTGAGCCCGCTCGGGGGGCAGGC

GGCCGGGGCCATGGGCGGCCTGGCCCCCTACGCCAACATGAACTCCATGA

GCCCCATGTACGGGCAGGCGGGCCTGAGCCGCGCCCGCGACCCCAAGACC

TACAGGCGCAGCTACACGCACGCAAAGCCGCCCTACTCGTACATCTCGCT

CATCACCATGGCCATCCAGCAGAGCCCCAACAAGATGCTGACGCTGAGCG

AGATCTACCAGTGGATCATGGACCTCTTCCCCTTCTACCGGCAGAACCAG

CAGCGCTGGCAGAACTCCATCCGCCACTCGCTCTCCTTCAACGACTGTTT

CCTGAAGGTGCCCCGCTCGCCCGACAAGCCCGGCAAGGGCTCCTTCTGGA

CCCTGCACCCTGACTCGGGCAACATGTTCGAGAACGGCTGCTACCTGCGC

CGCCAGAAGCGCTTCAAGTGCGAGAAGCAGCTGGCGCTGAAGGAGGCCGC

AGGCGCCGCCGGCAGCGGCAAGAAGGCGGCCGCCGGGGCCCAGGCCTCAC

AGGCTCAACTCGGGGAGGCCGCCGGGCCGGCCTCCGAGACTCCGGCGGGC

ACCGAGTCGCCTCACTCGAGCGCCTCCCCGTGCCAGGAGCACAAGCGAGG

GGGCCTGGGAGAGCTGAAGGGGACGCCGGCTGCGGCGCTGAGCCCCCCAG

AGCCGGCGCCCTCTCCCGGGCAGCAGCAGCAGGCCGCGGCCCACCTGCTG

GGCCCGCCCCACCACCCGGGCCTGCCGCCTGAGGCCCACCTGAAGCCGGA

ACACCACTACGCCTTCAACCACCCGTTCTCCATCAACAACCTCATGTCCT

CGGAGCAGCAGCACCACCACAGCCACCACCACCACCAGCCCCACAAAATG

GACCTCAAGGCCTACGAACAGGTGATGCACTACCCCGGCTACGGTTCCCC

CATGCCTGGCAGCTTGGCCATGGGCCCGGTCACGAACAAAACGGGCCTGG

ACGCCTCGCCCCTGGCCGCAGATACCTCCTACTACCAGGGGGTGTACTCC

CGGCCCATTATGAACTCCTCT,
```

or a nucleic acid sequence that hybridizes to a nucleic acid sequence consisting of SEQ ID NO:6 under stringent hybridization conditions.

In some embodiments, Forkhead box A3 (FOXA3) comprises the amino acid sequence:

```
                                   (SEQ ID NO: 7, NP_004488)
MLGSVKMEAHDLAEWSYYPEAGEVYSPVTPVPTMAPLNSYMTLNPLSSP

YPPGGLPASPLPSGPLAPPAPAAPLGPTFPGLGVSGGSSSSGYGAPGPG

LVHGKEMPKGYRRPLAHAKPPYSYISLITMAIQQAPGKMLTLSEIYQWI

MDLFPYYRENQQRWQNSIRHSLSFNDCFVKVARSPDKPGKGSYWALHPS

SGNMFENGCYLRRQKRFKLEEKVKKGGSGAATTTRNGTGSAASTTTPAA

TVTSPPQPPPPAPEPEAQGGEDVGALDCGSPASSTPYFTGLELPGELKL

DAPYNFNHPFSINNLMSEQTPAPPKLDVGFGGYGAEGGEPGVYYQGLYS

RSLLNAS,
```

or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:7.

In some embodiments, the nucleic acid sequence encoding FOXA3 comprises the nucleic acid sequence:

```
                                   (SEQ ID NO: 8; NM_004497)
ATGCTGGGCTCAGTGAAGATGGAGGCCCATGACCTGGCCGAGTGGAGCTA

CTACCCGGAGGCGGGCGAGGTCTACTCGCCGGTGACCCCAGTGCCCACCA

TGGCCCCCCTCAACTCCTACATGACCCTGAATCCTCTAAGCTCTCCCTAT

CCCCCTGGGGGGCTCCCTGCCTCCCCACTGCCCTCAGGACCCCTGGCACC

CCCAGCACCTGCAGCCCCCCTGGGGCCCACTTTCCCAGGCCTGGGTGTCA

GCGGTGGCAGCAGCAGCTCCGGGTACGGGGCCCCGGGTCCTGGGCTGGTG

CACGGGAAGGAGATGCCGAAGGGGTATCGGCGGCCCCTGGCACACGCCAA

GCCACCGTATTCCTATATCTCACTCATCACCATGGCCATCCAGCAGGCGC

CGGGCAAGATGCTGACCTTGAGTGAAATCTACCAGTGGATCATGGACCTC

TTCCCTTACTACCGGGAGAATCAGCAGCGCTGGCAGAACTCCATTCGCCA

CTCGCTGTCTTTCAACGACTGCTTCGTCAAGGTGGCGCGTTCCCCAGACA

AGCCTGGCAAGGGCTCCTACTGGGCCCTACACCCCAGCTCAGGGAACATG

TTTGAGAATGGCTGCTACCTGCGCCGCCAGAAACGCTTCAAGCTGGAGGA

GAAGGTGAAAAAAGGGGGCAGCGGGGCTGCCACCACCACCAGGAACGGGA

CAGGGTCTGCTGCCTCGACCACCACCCCCGCGGCCACAGTCACCTCCCCG

CCCCAGCCCCCGCCTCCAGCCCCTGAGCCTGAGGCCCAGGGCGGGGAAGA

TGTGGGGGCTCTGGACTGTGGCTCACCCGCTTCCTCCACACCCTATTTCA

CTGGCCTGGAGCTCCCAGGGGAGCTGAAGCTGGACGCGCCCTACAACTTC

AACCACCCTTTCTCCATCAACAACCTAATGTCAGAACAGACACCAGCACC

TCCCAAACTGGACGTGGGGTTTGGGGGCTACGGGGCTGAAGGTGGGGAGC

CTGGAGTCTACTACCAGGGCCTCTATTCCCGCTCTTTGCTTAATGCATC

C,
```

or a nucleic acid sequence that hybridizes to a nucleic acid sequence consisting of SEQ ID NO:8 under stringent hybridization conditions.

In some embodiments, Forkhead box B1 (FOXB1) comprises the amino acid sequence:

(SEQ ID NO: 10; NM_012182)

```
ATGCCTCGGCCCGGCCGCAACACGTACAGCGACCAGAAGCCGCCCTACTC

GTACATCTCGCTGACCGCTATGGCCATCCAGAGCTCTCCCGAGAAGATGC

TGCCGCTGAGCGAGATCTACAAGTTCATCATGGACCGCTTCCCCTACTAC

AGGGAGAACACGCAGCGCTGGCAGAACAGTCTGCGCCACAACCTCTCCTT

CAACGACTGCTTCATCAAGATCCCGCGGCGGCCGGACCAGCCAGGCAAGG

GCAGCTTCTGGGCGCTGCACCCAAGCTGCGGGGACATGTTCGAGAACGGC

AGCTTCCTGCGGCGCCGCAAGCGCTTCAAGGTGCTTAAGTCCGACCACCT

GGCGCCCAGCAAGCCAGCCGACGCGGCGCAGTACCTGCAGCAGCAGGCCA

AGCTGCGGCTCAGCGCGCTGGCGGCCTCGGGCACGCACCTGCCACAGATG

CCCGCCGCCGCCTACAACTTGGGCGGCGTGGCGCAGCCCTCGGGCTTCAA

GCACCCCTTCGCCATCGAGAACATCATCGCGCGGGAATACAAGATGCCTG

GGGGGCTGGCCTTCTCCGCCATGCAGCCGGTGCCCGCTGCCTACCCGCTC

CCCAACCAGTTGACTACCATGGGCAGCTCGCTGGGCACCGGCTGGCCACA

CGTGTATGGCTCCGCCGGCATGATCGACTCGGCCACCCCCATCTCCATGG

CGAGTGGCGACTACAGCGCCTACGGCGTGCCGTTGAAGCCGCTGTGCCAC

GCGGCGGGCCAAACGCTGCCCGCCATCCCCGTGCCCATTAAGCCCACGCC

GGCCGCCGTGCCCGCGCTGCCTGCGCTGCCAGCGCCCATCCCCACCTTGC

TCTCGAACTCGCCGCCCTCGCTCAGCCCCACGTCCTCGCAAACAGCCACC

AGCCAAAGCAGCCCCGCCACCCCCAGCGAAACGCTCACCAGCCCGGCCTC

CGCCTTGCACTCGGTGGCGGTGCAC,
```

or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:9.

In some embodiments, the nucleic acid sequence encoding FOXB1 comprises the nucleic acid sequence:

(SEQ ID NO: 9; NP_036314)

```
MPRPGRNTYSDQKPPYSYISLTAMAIQSSPEKMLPLSEIYKFIMDRFPYY

RENTQRWQNSLRHNLSFNDCFIKIPRRPDQPGKGSFWALHPSCGDMFENG

SFLRRRKRFKVLKSDHLAPSKPADAAQYLQQQAKLRLSALAASGTHLPQM

PAAAYNLGGVAQPSGFKHPFAIENIIAREYKMPGGLAFSAMQPVPAAYPL

PNQLTTMGSSLGTGWPHVYGSAGMIDSATPISMASGDYSAYGVPLKPLCH

AAGQTLPAIPVPIKPTPAAVPALPALPAPIPTLLSNSPPSLSPTSSQTAT

SQSSPATPSETLTSPASALHSVAVH,
```

or a nucleic acid sequence that hybridizes to a nucleic acid sequence consisting of SEQ ID NO:10 under stringent hybridization conditions.

In some embodiments, Forkhead box B2 (FOXB2) comprises the amino acid sequence:

(SEQ ID NO: 11; NP_001013757)

```
MPRPGKSSYSDQKPPYSYISLTAMAIQHSAEKMLPLSDIYKFIMERFPYY

REHTQRWQNSLRHNLSFNDCFIKIPRRPDQPGKGSFWALHPDCGDMFENG

SFLRRRKRFKVLRADHTHLHAGSTKSAPGAGPGGHLHPHHHHHPHHHHHH

HAAAHHHHHHHPPQPPPPPPPPPPHMVHYFHQQPPTAPQPPPHLPSQPPQ

QPPQQSQPQQPSHPGKMQEAAAVAAAAAAAAAAAVGSVGRLSQFPPYGLG

SAAAAAAAAAASTSGFKHPFAIENIIGRDYKGVLQAGGLPLASVMHHLGY

PVPGQLGNVVSSVWPHVGVMDSVAAAAAAAAAAGVPVGPEYGAFGVPVKS

LCHSASQSLPAMPVPIKPTPALPPVSALQPGLTVPAASQQPPAPSTVCSA

AAASPVASLLEPTAPTSAESKGGSLHSVLVHS,
```

or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:11.

In some embodiments, the nucleic acid sequence encoding FOXB2 comprises the nucleic acid sequence (SEQ ID NO: 12; NM_001013735)

```
ATGCCTCGGCCCGGCAAGTCATCTTATTCTGATCAAAAGCCACCCTACTC

ATATATTAGCCTCACAGCGATGGCTATACAGCATTCAGCTGAGAAGATGT

TGCCTCTCTCCGACATCTACAAATCATCATGGAGCGGTTCCCCTACTACC

GCGAACACACCCAGCGGTGGCAGAACTCACTTAGACACAACCTGAGCTTC

AATGATTGTTTTATTAAGATTCCCAGGAGGCCGGACCAGCCAGGCAAGGG

TTCATTCTGGGCACTCCACCCCGATTGCGGAGACATGTTTGAAAACGGGA

GCTTTCTCCGACGACGGAAGAGATTTAAGGTCCTGAGAGCCGATCATACC

CATCTCCACGCCGGGTCCACTAAATCTGCACCGGGGGCCGGCCCAGGCGG

GCATCTCCATCCCCACCACCACCATCACCCCCATCACCATCATCATCACC

ACGCCGCTGCACACCACCACCATCACCACCACCCCCCACAACCACCCCCT

CCCCCGCCACCCCCGCCACCCCACATGGTCCACTACTTTCACCAACAGCC

CCCCACCGCCCCGCAGCCCCCGCCCCACCTGCCATCACAGCCCCCCCAGC

AGCCCCCACAGCAAAGCCAGCCCCAGCAACCTAGCCATCCTGGTAAAATG

CAGGAGGCTGCGGCGGTGGCTGCGGCTGCAGCTGCCGCTGCTGCTGCGGC

TGTTGGGTCTGTGGGCAGACTGAGCCAGTTCCCTCCCTACGGCTTGGGTT

CCGCCGCCGCGGCGGCCGCCGCCGCTGCAGCCAGCACTTCCGGCTTTAAG

CATCCATTTGCTATTGAGAACATCATTGGCCGCGACTATAAAGGCGTCCT

CCAAGCCGGAGGACTCCCACTCGCGAGTGTGATGCATCACTTGGGCTATC

CAGTGCCAGGCCAGCTGGGTAACGTCGTGTCCTCCGTCTGGCCCCACGTG

GGGGTAATGGACAGTGTGGCAGCAGCCGCTGCCGCTGCAGCTGCCGCTGG

CGTTCCAGTAGGTCCCGAATATGGAGCATTCGGCGTGCCCGTGAAGTCCC

TGTGCCACTCTGCAAGCCAGAGCCTGCCAGCCATGCCGGTGCCCATCAAG

CCAACACCAGCCCTCCCACCAGTGTCTGCCTTGCAGCCAGGACTCACGGT
```

-continued

GCCCGCCGCATCTCAGCAGCCTCCAGCACCCTCAACGGTGTGCAGCGCCG

CAGCCGCTAGCCCCGTGGCCAGCCTCCTGGAACCCACTGCACCCACATCA

GCTGAGTCAAAAGGTGGAAGCCTTCATTCCGTGTTGGTGCACTCA, or a nucleic acid sequence that hybridizes to a nucleic acid sequence consisting of SEQ ID NO:12 under stringent hybridization conditions.

In some embodiments, Forkhead box C1 (FOXC1) comprises the amino acid sequence:

(SEQ ID NO: 13; NP_001444)

MQARYSVSSPNSLGVVPYLGGEQSYYRAAAAAAGGGYTAMPAPMSVYSHP

AHAEQYPGGMARAYGPYTPQPQPKDMVKPPYSYIALITMAIQNAPDKKIT

LNGIYQFIMDRFPFYRDNKQGWQNSIRHNLSLNECFVKVPRDDKKPGKGS

YVVTLDPDSYNMFENGSFLRRRRRFKKKDAVKDKEEKDRLHLKEPPPPGR

QPPPAPPEQADGNAPGPQPPPVRIQDIKTENGTCPSPPQPLSPAAALGSG

SAAAVPKIESPDSSSSSLSSGSSPPGSLPSARPLSLDGADSAPPPPAPSA

PPPHHSQGFSVDNIMTSLRGSPQSAAAELSSGLLASAAASSRAGIAPPLA

LGAYSPGQSSLYSSPCSQTSSAGSSGGGGGGAGAAGGAGGAGTYHCNLQA

MSLYAAGERGGHLQGAPGGAGGSAVDDPLPDYSLPPVTSSSSSSLSHGGG

GGGGGGGQEAGHHPAAHQGRLTSVVYLNQAGGDLGHLASAAAAAAAAGYP

GQQQNFHSVREMFESQRIGLNNSPVNGNSSCQMAFPSSQSLYRTSGAFVY

DCSKF, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:13.

In some embodiments, the nucleic acid sequence encoding FOXC1 comprises the nucleic acid sequence:

(SEQ ID NO: 14; NM_001453)

ATGCAGGCGCGCTACTCCGTGTCCAGCCCCAACTCCCTGGGAGTGGTG

CCCTACCTCGGCGGCGAGCAGAGCTACTACCGCGCGGCGGCCGCGGCGGC

CGGGGGCGGCTACACCGCCATGCCGGCCCCCATGAGCGTGTACTCGCACC

CTGCGCACGCCGAGCAGTACCCGGGCGGCATGGCCCGCGCCTACGGGCCC

TACACGCCGCAGCCGCAGCCCAAGGACATGGTGAAGCCGCCCTATAGCTA

CATCGCGCTCATCACCATGGCCATCCAGAACGCCCCGGACAAGAAGATCA

CCCTGAACGGCATCTACCAGTTCATCATGGACCGCTTCCCCTTCTACCGG

GACAACAAGCAGGGCTGGCAGAACAGCATCCGCCACAACCTCTCGCTCAA

CGAGTGCTTCGTCAAGGTGCCGCGCGACGACAAGAAGCCGGGCAAGGGCA

GCTACTGGACGCTGGACCCGGACTCCTACAACATGTTCGAGAACGGCAGC

TTCCTGCGGCGGCGGCGGCGCTTCAAGAAGAAGGACGCGGTGAAGGACAA

GGAGGAGAAGGACAGGCTGCACCTCAAGGAGCCGCCCCCGCCCGGCCGCC

AGCCCCCGCCCGCGCCGCCGGAGCAGGCCGACGGCAACGCGCCCGGTCCG

CAGCCGCCGCCCGTGCGCATCCAGGACATCAAGACCGAGAACGGTACGTG

CCCCTCGCCGCCCCAGCCCCTGTCCCCGGCCGCCGCCCTGGGCAGCGGCA

-continued

GCGCCGCCGCGGTGCCCAAGATCGAGAGCCCCGACAGCAGCAGCAGCAGC

CTGTCCAGCGGGAGCAGCCCCCCGGGCAGCCTGCCGTCGGCGCGGCCGCT

CAGCCTGGACGGTGCGGATTCCGCGCCGCCGCCGCCCGCGCCCTCCGCCC

CGCCGCCGCACCATAGCCAGGGCTTCAGCGTGGACAACATCATGACGTCG

CTGCGGGGGTCGCCGCAGAGCGCGGCCGCGGAGCTCAGCTCCGGCCTTCT

GGCCTCGGCGGCCGCGTCCTCGCGCGCGGGGATCGCACCCCCGCTGGCGC

TCGGCGCCTACTCGCCCGGCCAGAGCTCCCTCTACAGCTCCCCCTGCAGC

CAGACCTCCAGCGCGGGCAGCTCGGGCGGCGGCGGCGGCGGCGCGGGGGC

CGCGGGGGGCGCGGGCGGCGCCGGGACCTACCACTGCAACCTGCAAGCCA

TGAGCCTGTACGCGGCCGGCGAGCGCGGGGGCCACTTGCAGGGCGCGCCC

GGGGGCGCGGGCGGCTCGGCCGTGGACGACCCCCTGCCCGACTACTCTCT

GCCTCCGGTCACCAGCAGCAGCTCGTCGTCCCTGAGTCACGGCGGCGGCG

GCGGCGGCGGCGGGGGAGGCCAGGAGGCCGGCCACCACCCTGCGGCCCAC

CAAGGCCGCCTCACCTCGTGGTACCTGAACCAGGCGGGCGGAGACCTGGG

CCACTTGGCGAGCGCGGCGGCGGCGGCGGCGGCCGCAGGCTACCCGGGCC

AGCAGCAGAACTTCCACTCGGTGCGGGAGATGTTCGAGTCACAGAGGATC

GGCTTGAACAACTCTCCAGTGAACGGGAATAGTAGCTGTCAAATGGCCTT

CCCTTCCAGCCAGTCTCTGTACCGCACGTCCGGAGCTTTCGTCTACGACT

GTAGCAAGTTT, or a nucleic acid sequence that hybridizes to a nucleic acid sequence consisting of SEQ ID NO:14 under stringent hybridization conditions.

In some embodiments, Forkhead box C2 (FOXC2) comprises the amino acid sequence (SEQ ID NO: 15; NP_005242)

MQARYSVSDPNALGVVPYLSEQNYYRAAGSYGGMASPMGVYSGHPEQYSA

GMGRSYAPYHHHQPAAPKDLVKPPYSYIALITMAIQNAPEKKITLNGIYQ

FIMDRFPFYRENKQGWQNSIRHNLSLNECFVKVPRDDKKPGKGSYVVTLD

PDSYNMFENGSFLRRRRRFKKKDVSKEKEERAHLKEPPPAASKGAPATPH

LADAPKEAEKKVVIKSEAASPALPVITKVETLSPESALQGSPRSAASTPA

GSPDGSLPEHHAAAPNGLPGFSVENIMTLRTSPPGGELSPGAGRAGLVVP

PLALPYAAAPPAAYGQPCAQGLEAGAAGGYQCSMRAMSLYTGAERPAHMC

VPPALDEALSDHPSGPTSPLSALNLAAGQEGALAATGHHHQHHGHHHPQA

PPPPPAPQPQPTPQPGAAAAQAASVVYLNHSGDLNHLPGHTFAAQQQTFP

NVREMFNSHRLGIENSTLGESQVSGNASCQLPYRSTPPLYRHAAPYSYDC

TKY,

NP 005242), or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:15.

In some embodiments, the nucleic acid sequence encoding FOXC2 comprises the nucleic acid sequence:

(SEQ ID NO: 16; NM_005251)

ATGCAGGCGCGCTACTCCGTGTCCGACCCCAACGCCCTGGGAGTGGTG

CCCTACCTGAGCGAGCAGAATTACTACCGGGCTGCGGGCAGCTACGGCGG

CATGGCCAGCCCCATGGGCGTCTATTCCGGCCACCCGGAGCAGTACAGCG

CGGGGATGGGCCGCTCCTACGCGCCCTACCACCACCACCAGCCCGCGGCG

CCTAAGGACCTGGTGAAGCCGCCCTACAGCTACATCGCGCTCATCACCAT

GGCCATCCAGAACGCGCCCGAGAAGAAGATCACCTTGAACGGCATCTACC

AGTTCATCATGGACCGCTTCCCCTTCTACCGGGAGAACAAGCAGGGCTGG

CAGAACAGCATCCGCCACAACCTCTCGCTCAACGAGTGCTTCGTCAAGGT

GCCCCGCGACGACAAGAAGCCCGGCAAGGGCAGTTACTGGACCCTGGACC

CGGACTCCTACAACATGTTCGAGAACGGCAGCTTCCTGCGGCGCCGGCGG

CGCTTCAAAAAGAAGGACGTGTCCAAGGAGAAGGAGGAGCGGGCCCACCT

CAAGGAGCCGCCCCCGGCGGCGTCCAAGGGCGCCCCGGCCACCCCCCACC

TAGCGGACGCCCCCAAGGAGGCCGAGAAGAAGGTGGTGATCAAGAGCGAG

GCGGCGTCCCCGGCGCTGCCGGTCATCACCAAGGTGGAGACGCTGAGCCC

CGAGAGCGCGCTGCAGGGCAGCCCGCGCAGCGCGGCCTCCACGCCCGCCG

GCTCCCCCGACGGCTCGCTGCCGGAGCACCACGCCGCGGCGCCCAACGGG

CTGCCTGGCTTCAGCGTGGAGAACATCATGACCCTGCGAACGTCGCCGCC

GGGCGGAGAGCTGAGCCCGGGGGCCGGACGCGCGGGCCTGGTGGTGCCGC

CGCTGGCGCTGCCCTACGCCGCCGCGCCGCCCGCCGCCTACGGCCAGCCG

TGCGCTCAGGGCCTGGAGGCCGGGGCCGCCGGGGGCTACCAGTGCAGCAT

GCGAGCGATGAGCCTGTACACCGGGGCCGAGCGGCCGGCGCACATGTGCG

TCCCGCCCGCCCTGGACGAGGCCCTCTCGGACCACCCGAGCGGCCCCACG

TCGCCCCTGAGCGCTCTCAACCTCGCCGCCGGCCAGGAGGGCGCGCTCGC

CGCCACGGGCCACCACCACCAGCACCACGGCCACCACCACCCGCAGGCGC

CGCCGCCCCCGCCGGCTCCCCAGCCCCAGCCGACGCCGCAGCCCGGGGCC

GCCGCGGCGCAGGCGGCCTCCTGGTATCTCAACCACAGCGGGGACCTGAA

CCACCTCCCCGGCCACACGTTCGCGGCCCAGCAGCAAACTTTCCCCAACG

TGCGGGAGATGTTCAACTCCCACCGGCTGGGGATTGAGAACTCGACCCTC

GGGGAGTCCCAGGTGAGTGGCAATGCCAGCTGCCAGCTGCCCTACAGATC

CACGCCGCCTCTCTATCGCCACGCAGCCCCCTACTCCTACGACTGCACGA

AATAC, or a nucleic acid sequence that hybridizes to a nucleic acid sequence consisting of SEQ ID NO:16 under stringent hybridization conditions.

In some embodiments, Forkhead box D1 (FOXD1) comprises the amino acid sequence:

(SEQ ID NO: 17; NP_004463)

MTLSTEMSDASGLAEETDIDVVGEGEDEEDEEEEDDDEGGGGGPRLAVPA

QRRRRRRSYAGEDELEDLEEEEDDDDILLAPPAGGSPAPPGPAPAAGAGA

GGGGGGGGAGGGGSAGSGAKNPLVKPPYSYIALITMAILQSPKKRLTLSE

-continued

ICEFISGRFPYYREKFPAWQNSIRHNLSLNDCFVKIPREPGNPGKGNYWT

LDPESADMFDNGSFLRRRKRFKRQPLLPPNAAAAESLLLRGAGAAGGAGD

PAAAAALFPPAPPPPPHAYGYGPYGCGYGLQLPPYAPPSALFAAAAAAAA

AAAFHPHSPPPPPPPHGAAAELARTAFGYRPHPLGAALPGPLPASAAKAG

GPGASALARSPFSIESIIGGSLGPAAAAAAAAQAAAAAQASPSPSPVAAP

PAPGSSGGGCAAQAAVGPAAALTRSLVAAAAAAAASSVSSSAALGTLHQGT

ALSSVENFTARISNC, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:17.

In some embodiments, the nucleic acid sequence encoding FOXD1 comprises the nucleic acid sequence:

(SEQ ID NO: 18; NM_004472)

ATGACCCTGAGCACTGAGATGTCCGATGCCTCTGGCCTCGCCGAGGAAAC

AGACATCGACGTGGTGGGGGAGGGCGAGGACGAAGAAGACGAGGAAGAGG

AGGACGACGACGAGGGCGGCGGTGGCGGGCCCCGGCTGGCTGTCCCCGCG

CAGCGGCGGCGGCGGCGGCGCTCGTACGCCGGGGAGGACGAGCTGGAGGA

TCTGGAGGAGGAGGAGGACGACGATGACATCCTGCTGGCCCCGCCTGCTG

GGGGCTCCCCGGCGCCCCCGGGCCCGGCCCCGGCGGCGGGGGCAGGAGCC

GGTGGGGGCGGCGGCGGCGGCGGCGCGGGCGGCGGCGGGAGCGCGGGTAG

CGGCGCCAAGAACCCGCTGGTGAAGCCGCCCTACTCGTATATCGCGCTCA

TCACTATGGCCATCCTGCAGAGCCCCAAGAAGCGGCTGACGCTGAGCGAG

ATCTGTGAGTTCATCAGCGGCCGCTTCCCCTACTACCGGGAGAAGTTCCC

CGCCTGGCAGAACAGCATCCGCCACAACCTCTCGCTCAACGACTGCTTCG

TCAAGATCCCCCGCGAGCCCGGCAACCCGGGCAAGGGCAACTACTGGACG

CTGGACCCGGAGTCCGCCGACATGTTCGACAACGGCAGCTTCCTGCGCCG

GAGGAAGCGCTTCAAGCGGCAGCCGCTGCTCCCACCCAACGCCGCGGCCG

CCGAGTCTCTGCTGCTGCGCGGCGCGGGAGCCGCAGGGGGCGCGGGCGAC

CCGGCAGCCGCCGCCGCGCTCTTCCCGCCCGCGCCCCCGCCGCCCCCGCA

TGCCTACGGCTACGGCCCCTACGGCTGCGGCTACGGCCTGCAGCTGCCGC

CTTACGCGCCGCCCTCGGCCCTCTTCGCCGCCGCAGCGGCCGCCGCCGCC

GCCGCCGCCTTCCACCCGCACTCGCCCCCGCCGCCCCCGCCACCGCACGG

CGCGGCCGCCGAGCTGGCCCGGACCGCCTTCGGCTACCGGCCGCACCCGC

TCGGCGCCGCCCTACCCGGCCCCCTGCCGGCCTCCGCGGCCAAGGCGGGC

GGCCCGGGCGCCTCAGCGCTGGCGCGCTCGCCCTTCTCCATCGAGAGCAT

CATCGGGGGCAGCTTGGGCCCGGCCGCCGCTGCCGCCGCCGCCGCGCAGG

CCGCCGCCGCCGCTCAGGCCTCGCCCTCGCCCTCGCCGGTGGCGGCGCCG

CCAGCTCCCGGATCCAGCGGAGGAGGCTGCGCGGCGCAGGCGGCCGTGGG

CCCGGCGGCCGCGCTCACCCGATCCCTCGTGGCCGCCGCGGCCGCCGCCG

CCTCCTCAGTCTCCTCGTCCGCCGCCTTGGGGACTCTGCACCAAGGGACT

-continued

GCCCTGTCCAGTGTCGAGAACTTTACTGCTAGGATTTCCAATTGT, or a nucleic acid sequence that hybridizes to a nucleic acid sequence consisting of SEQ ID NO:18 under stringent hybridization conditions.

In some embodiments, Forkhead box D2 (FOXD2) comprises the amino acid sequence:

(SEQ ID NO: 19; NP_004465)

MTLGSCCCEIMSSESSPAALSEADADIDVVGGGSGGGELPARSGPRAPRD

VLPHGHEPPAEEAEADLAEDEEESGGCSDGEPRALASRGAAAAAGSPGPG

AAAARGAAGPGPGPPSGGAATRSPLVKPPYSYIALITMAILQSPKKRLTL

SEICEFISGRFPYYREKFPAWQNSIRHNLSLNDCFVKIPREPGNPGKGNY

WTLDPESADMFDNGSFLRRRKRFKRQPLPPPHPHPHPHPELLLRGGAAAA

GDPGAFLPGFAAYGAYGYGYGLALPAYGAPPPGPAPHPHPHPHAFAFAAA

AAAAPCQLSVPPGRAAAPPPGPPTASVFAGAGSAPAPAPASGSGPGPGPA

GLPAFLGAELGCAKAFYPASLSPPAAGTAAGLPTALLRQGLKTDAGGGAG

GGGAGAGQRPSFSIDHIMGHGGGGAAPPGAGEGSPGPPFAAAAGPGGQAQ

VLAMLTAPALAPVAGHIRLSHPGDALLSSGSRFASKVAGLSGCHF, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:19.

In some embodiments, the nucleic acid sequence encoding FOXD2 comprises the nucleic acid sequence:

(SEQ ID NO: 20; NM_004474)

ATGACCCTGGGCAGCTGCTGCTGCGAGATCATGTCCTCCGAGAGCTCCCC

GGCCGCGCTGTCCGAGGCCGACGCAGACATAGACGTGGTGGGCGGCGGCA

GCGGCGGGGGGGAGCTCCCAGCTCGCTCCGGGCCCCGCGCCCCCGGGAC

GTGCTCCCCCACGGCCACGAGCCTCCCGCGGAGGAAGCCGAGGCAGACTT

AGCCGAGGACGAGGAGGAGTCTGGTGGCTGCTCGGACGGCGAGCCCCGCG

CTCTGGCGTCCCGGGGGGCGGCGGCCGCAGCGGGGAGCCCGGGGCCAGGC

GCCGCGGCGGCCCGCGGCGCAGCGGGGCCCGGGCCGGGACCGCCGTCGGG

GGGCGCGGCGACGCGGAGCCCGCTGGTGAAGCCGCCCTACTCGTACATCG

CGCTCATCACCATGGCCATCCTGCAGAGCCCCAAGAAGCGGCTGACGTTG

AGCGAGATCTGCGAGTTCATCAGCGGCCGCTTCCCCTACTACCGGGAGAA

GTTCCCCGCCTGGCAGAACAGCATCCGCCACAACCTCTCTCTCAACGACT

GCTTCGTCAAGATCCCCCGCGAGCCGGGCAACCCGGGCAAGGGCAACTAC

TGGACGCTGGACCCGGAGTCGGCCGACATGTTCGACAACGGCAGCTTCCT

GCGGCGTCGCAAGCGCTTCAAGCGGCAGCCCCTGCCGCCGCCGCACCCAC

ACCCGCACCCTCACCCGGAGCTGCTGCTGCGTGGCGGGGCCGCGGCGGCG

GGGGATCCCGGCGCTTTCCTGCCCGGCTTCGCTGCCTACGGCGCCTACGG

CTACGGCTACGGGCTGGCTCTCCCGGCCTACGGCGCACCCCCGCCGGGGC

CGGCCCCGCATCCGCACCCGCACCCGCACGCCTTCGCTTTCGCCGCGGCA

GCCGCCGCCGCTCCTTGCCAGCTGTCGGTACCCCCAGGCCGCGCCGCCGC

-continued

GCCTCCACCCGGACCTCCGACGGCCTCGGTGTTCGCAGGCGCGGGATCGG

CCCCAGCTCCTGCGCCTGCCTCAGGCTCGGGCCCGGGCCCGGGCCCCGCA

GGCCTGCCCGCCTTCCTGGGCGCGGAGCTGGGCTGCGCCAAAGCCTTCTA

CCCGGCGTCCCTGAGTCCTCCCGCAGCCGGCACCGCGGCGGGTCTGCCCA

CCGCACTTCTGCGCCAGGGCCTCAAGACGGACGCGGGCGGTGGTGCAGGC

GGCGGGGGCGCCGGGGCAGGGCAGAGGCCTTCCTTCTCTATAGACCACAT

CATGGGCCACGGTGGCGGCGGGGCAGCACCCCCGGGCGCCGGCGAGGGCT

CTCCGGGACCGCCATTCGCGGCAGCCGCGGGTCCTGGGGGCCAAGCCCAG

GTCTTGGCCATGCTGACTGCTCCGGCCCTGGCTCCCGTTGCTGGCCACAT

TCGCCTCTCGCATCCCGGGGACGCGCTGCTGTCCTCAGGGTCCCGGTTTG

CCAGCAAAGTCGCCGGCCTTAGTGGCTGCCACTTC, or a nucleic acid sequence that hybridizes to a nucleic acid sequence consisting of SEQ ID NO:20 under stringent hybridization conditions.

In some embodiments, Forkhead box D3 (FOXD3) comprises the amino acid sequence:

(SEQ ID NO: 21; NP_036315)

MTLSGGGSASDMSGQTVLTAEDVDIDVVGEGDDGLEEKDSDAGCDSPAGP

PELRLDEADEVPPAAPHHGQPQPPHQQPLTLPKEAAGAGAGPGGDVGAPE

ADGCKGGVGGEEGGASGGGPGAGSGSAGGLAPSKPKNSLVKPPYSYIALI

TMAILQSPQKKLTLSGICEFISNRFPYYREKFPAWQNSIRHNLSLNDCFV

KIPREPGNPGKGNYWTLDPQSEDMFDNGSFLRRRKRFKRHQQEHLREQTA

LMMQSFGAYSLAAAAGAAGPYGRPYGLHPAAAAGAYSHPAAAAAAAAAAA

LQYPYALPPVAPVLPPAVPLLPSGELGRKAAAFGSQLGPGLQLQLNSLGA

AAAAAGTAGAAGTTASLIKSEPSARPSFSIENIIGGGPAAPGGSAVGAGV

AGGTGGSGGGSTAQSFLRPPGTVQSAALMATHQPLSLSRTTATIAPILSV

PLSGQFLQPAASAAAAAAAAAQAKWPAQ, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:21.

In some embodiments, the nucleic acid sequence encoding FOXD3 comprises the nucleic acid sequence:

(SEQ ID NO: 22; NM_012183)

ATGACCCTCTCCGGCGGCGGCAGCGCCAGCGACATGTCCGGCCAGACGGT

GCTGACGGCCGAGGACGTGGACATCGATGTGGTGGGCGAGGGCGACGACG

GGCTGGAAGAGAAGGACAGCGACGCAGGTTGCGATAGCCCCGCGGGGCCG

CCGGAGCTGCGCCTGGACGAGGCGGACGAGGTGCCCCCGGCGGCACCCCA

TCACGGACAGCCTCAGCCGCCCCACCAGCAGCCCCTGACATTGCCCAAGG

AGGCGGCCGGAGCCGGGGCCGGACCGGGGGGCGACGTGGGCGCGCCGGAG

GCGGACGGCTGCAAGGGCGGTGTTGGCGGCGAGGAGGGCGGCGCGAGCGG

CGGCGGGCCTGGCGCGGGCAGCGGTTCGGCGGGAGGCCTGGCCCCGAGCA

-continued

AGCCCAAGAACAGCCTAGTGAAGCCGCCTTACTCGTACATCGCGCTCATC

ACCATGGCCATCCTGCAGAGCCCGCAGAAGAAGCTGACCCTGAGCGGCAT

CTGCGAGTTCATCAGCAACCGCTTCCCCTACTACAGGGAGAAGTTCCCCG

CCTGGCAGAACAGCATCCGCCACAACCTCTCACTCAACGACTGCTTCGTC

AAGATCCCCCGCGAGCCGGGCAACCCGGGCAAGGGCAACTACTGGACCCT

GGACCCGCAGTCCGAGGACATGTTCGACAACGGCAGCTTCCTGCGGCGCC

GGAAACGCTTCAAGCGCCACCAGCAGGAGCACCTGCGCGAGCAGACGGCG

CTCATGATGCAGAGCTTCGGCGCTTACAGCCTGGCGGCGGCGGCCGGCGC

CGCGGGACCCTACGGCCGCCCCTACGGCCTGCACCCTGCGGCGGCGGCCG

GTGCCTATTCGCACCCGGCAGCGGCGGCGGCCGCGGCTGCTGCGGCGGCG

CTCCAGTACCCGTACGCGCTGCCGCCGGTGGCACCGGTGCTGCCTCCCGC

TGTGCCGCTGCTGCCCTCGGGCGAGCTGGGCCGCAAAGCGGCCGCCTTCG

GCTCACAGCTCGGCCCGGGCCTGCAGCTGCAGCTCAATAGCCTGGGCGCC

GCCGCGGCCGCTGCGGGCACAGCGGGCGCCGCGGGCACCACCGCGTCGCT

CATCAAGTCCGAGCCAAGCGCGCGGCCGTCGTTCAGCATCGAGAACATCA

TAGGTGGGGGCCCCGCGGCTCCTGGGGGCTCGGCGGTGGGCGCTGGGGTC

GCCGGCGGCACTGGGGGTTCAGGGGGCGGCAGCACGGCGCAGTCGTTTCT

GCGGCCACCCGGGACCGTGCAGTCGGCAGCGCTCATGGCCACCCACCAAC

CGCTGTCGCTGAGCCGGACGACTGCCACCATCGCGCCCATTCTTAGCGTG

CCACTCTCCGGACAGTTTCTGCAGCCCGCAGCCTCGGCCGCCGCCGCTGC

TGCGGCCGCCGCTCAAGCCAAATGGCCGGCGCAA, or a nucleic acid sequence that hybridizes to a nucleic acid sequence consisting of SEQ ID NO:22 under stringent hybridization conditions.

In some embodiments, Forkhead box D4 (FOXD4) comprises the amino acid sequence:

(SEQ ID NO: 23; NP_997188)

MNLPRAERLRSTPQRSLRDSDGEDGKIDVLGEEEDEDEEEAASQQFLEQS

LQPGLQVARWGGVALPREHIEGGGGPSDPSEFGTEFRAPPRSAAASEDAR

QPAKPPSSYIALITMAILQSPHKRLTLSGICAFISDRFPYYRRKFPAWQN

SIRHNLSLNDCFVKIPREPGRPGKGNYWSLDPASQDMFDNGSFLRRRKRF

QRHQPTPGAHLPHPFPLPAAHAALHNPRPGPLLGAPAPPQPVPGAYPNTG

PGRRPYALLHPHPPRYLLLSAPAYAGAPKKAEGADLATPAPFPCCSPHLV

LSLGRRARVWRRHREADASLSALRVSCKGSGERVQGLRRVCPRPRGATAP

CSSDRQACRTILQQQQRHQEEDCANGCAPTKGAVLGGHLSAASALLRYQA

VAEGSGLTSLAAPLGGEGTSPVFLVSPTPSSLAESAGPS, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:23.

In some embodiments, the nucleic acid sequence encoding FOXD4 comprises the nucleic acid sequence:

(SEQ ID NO: 24; NM_207305)

ATGAACTTGCCAAGAGCTGAGCGCCTTCGCTCCACACCGCAGCGCAGCCT

CCGGGACTCCGATGGGGAAGACGGTAAAATCGATGTCCTGGGAGAGGAGG

AAGATGAAGACGAGGAGGAGGCGGCGAGCCAGCAGTTCCTAGAGCAGTCG

CTCCAGCCGGGGCTGCAGGTGGCCCGGTGGGGCGGGGTTGCGCTTCCCCG

AGAGCACATCGAGGGCGGCGGCGGCCCGAGCGACCCCTCAGAGTTTGGCA

CCGAGTTCAGGGCACCGCCAAGGTCTGCGGCGGCCTCTGAAGATGCCCGG

CAGCCGGCAAAGCCCCCCTCCTCGTACATCGCGCTCATCACCATGGCCAT

CCTGCAAAGCCCGCACAAGCGCCTCACGCTCAGCGGCATCTGCGCCTTCA

TTAGTGACCGCTTCCCCTACTACCGCCGCAAGTTCCCCGCCTGGCAGAAC

AGCATCCGCCACAACCTCTCGCTGAACGACTGCTTCGTCAAGATCCCCCG

CGAGCCGGGCCGCCCAGGCAAGGGCAACTACTGGAGCCTGGACCCCGCCT

CCCAGGACATGTTCGACAATGGCAGCTTTCTCCGGCGTAGGAAGCGTTTC

CAGCGCCACCAACCGACCCCGGGAGCCCACCTGCCCCACCCCTTCCCTCT

ACCTGCTGCACACGCCGCCCTGCACAACCCCCGCCCAGGCCCTCTGCTTG

GGGCCCCTGCCCCGCCGCAGCCAGTCCCGGGGGCCTACCCCAACACCGGC

CCCGGGAGACGCCCTTACGCTCTGCTGCACCCGCATCCTCCTCGCTACCT

ACTGCTCTCGGCCCCCGCCTATGCCGGGGCACCGAAGAAAGCAGAAGGCG

CGGACCTGGCGACCCCGGCACCCTTCCCGTGCTGCAGCCCTCACTTGGTC

CTCAGCCTTGGGAGGAGGGCAAGGGTCTGGCGTCGCCACCGGGAGGCGGA

TGCATCTCTTTCAGCATTGAGAGTATCATGCAAGGGGTCAGGGGAGCGGG

TACAGGGGCTGCGCAGAGTTTGTCCCCGACCGCGTGGAGCTACTGCCCCC

TGCTCCAGCGACCGTCAAGCCTGTCGGACAATTTTGCAGCAACAGCAGCG

GCATCAGGAGGAGGACTGCGCCAACGGCTGCGCTCCCACCAAGGGCGCGG

TGCTGGGCGGGCACCTGTCGGCCGCGTCGGCGCTGCTGCGGTATCAGGCG

GTGGCAGAGGGCTCTGGGCTGACATCGCTGGCCGCCCCTTTGGGCGGAGA

GGGGACCTCACCAGTTTTTTTAGTATCGCCCACGCCCAGTTCCCTGGCCG

AGTCCGCAGGGCCCTCC, or a nucleic acid sequence that hybridizes to a nucleic acid sequence consisting of SEQ ID NO:24 under stringent hybridization conditions.

In some embodiments, Forkhead box D4 like 1 (FOXD5) comprises the amino acid sequence:

(SEQ ID NO: 25; NP_036316)

MNLPRAERPRSTPQRSLRDSDGEDGKIDVLGEEEDEDEVEDEEEEASQKF

LEQSLQPGLQVARWGGVALPREHIEGGGPSDPSEFGTEFRAPPRSAAASE

DARQPAKPPYSYIALITMAILQSPHKRLTLSGICAFISGRFPYYRRKFPA

WQNSIRHNLSLNDCFVKIPREPGHPGKGTYWSLDPASQDMFDNGSFLRRR

KRFKRHQLTPGAHLPHPFPLPAAHAALHNPRPGPLLGAPALPQPVPGAYP

NTAPGRRPYALLHPHPPRYLLLSAPAYAGAPKKAEGADLATPGTLPVLQP

SLGPQPWEEGKGLASPPGGGCISFSIESIMQGVRGAGTGAAQSLSPTAWS

-continued

YCPLLQRPSSLSDNFAATAAASGGGLRQRLRSHQGRGAGRAPVGRVGAAA

VSGGGRGL, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:25.

In some embodiments, the nucleic acid sequence encoding FOXD5 comprises the nucleic acid sequence:

(SEQ ID NO: 26; NM_012184.4)

ATCTTTGCCGGACGTTGTTGCAAAGGAGTAGAAACAAGCAGAGGAAAACA

TCCCAAAGGGTAACCACTAGCGTTCCTGCTTCTTGCAACATTCATCCCAG

GCTTCCAGCTCAGCCCGCCCCGGGCCAGGTGATCGGCCGCCACATCCCCT

GCGACTGAAGCACCTGCTCCGCCATGAACCTGCCAAGAGCTGAGCGCCCT

CGCTCCACACCGCAGCGCAGCCTCCGGGACTCCGATGGGGAAGACGGTAA

AATCGATGTCCTGGGAGAGGAGGAAGATGAAGACGAGGTGGAAGACGAGG

AGGAGGAGGCGAGCCAGAAGTTCCTAGAGCAGTCGCTCCAGCCGGGGCTG

CAGGTGGCCCGGTGGGGCGGGGTTGCGCTTCCCCGAGAGCACATCGAGGG

CGGCGGCCCGAGCGACCCCTCAGAGTTTGGCACCGAGTTCAGGGCACCGC

CAAGGTCTGCGGCGGCCTCTGAAGATGCCCGGCAGCCGGCAAAGCCCCCC

TACTCGTACATCGCGCTCATCACCATGGCCATCCTGCAAAGCCCGCACAA

GCGCCTCACGCTCAGCGGCATCTGCGCCTTCATTAGTGGCCGCTTCCCCT

ACTACCGCCGCAAGTTCCCCGCCTGGCAGAACAGCATCCGCCACAACCTC

TCGCTGAACGACTGCTTCGTCAAGATCCCCCGCGAGCCGGGCCACCCAGG

CAAGGGCACCTACTGGAGCCTGGACCCCGCCTCCCAGGACATGTTCGACA

ATGGCAGCTTTCTCCGGCGTAGGAAGCGTTTCAAGCGCCACCAACTGACC

CCGGGAGCCCACCTGCCCCACCCCTTCCCTCTACCTGCTGCACACGCCGC

CCTGCACAACCCCCGCCCAGGCCCTCTGCTTGGGGCCCCTGCCCTGCCGC

AGCCAGTCCCGGGGGCCTACCCCAACACCGCCCCCGGGAGACGCCCTTAC

GCTCTGCTGCACCCGCATCCTCCTCGCTACCTACTGCTCTCGGCCCCCGC

CTATGCCGGGGCACCGAAGAAAGCAGAAGGCGCGGACCTGGCGACCCCCG

GCACCCTTCCCGTGCTGCAGCCCTCACTTGGTCCTCAGCCTTGGGAGGAG

GGCAAGGGTCTGGCGTCGCCACCGGGAGGCGGATGCATCTCTTTCAGCAT

TGAGAGTATCATGCAAGGGGTCAGGGGAGCGGGTACAGGGGCTGCGCAGA

GTTTGTCCCCGACCGCGTGGAGCTACTGCCCCCTGCTCCAGCGACCGTCA

AGCCTGTCGGACAATTTTGCAGCAACAGCAGCAGCATCAGGAGGAGGACT

GCGCCAACGGCTGCGCTCCCACCAAGGGCGCGGTGCTGGGCGGGCACCTG

TCGGCCGCGTCGGCGCTGCTGCGGTATCAGGCGGTGGCAGAGGGCTCTAG

GCTGACATCGCTGGCTGCCCCTTTGGGCGGAGAGGGGACCTCACCAGTTT

TTTTAGTATCGCCCACGCCCAGTTCCCTGGCCAAGTCCGCAGGGCCCTCC

TAGAGCCAGGTGGGAGTGGGGAGCGATCCGCAGCTGCTCACTCCACCTTG

CGCGGCCCATACTGGGCGTGTGCATCTGAATCCTGCTGGAGAGCAAACAC

-continued

GAACTTCTGTTCCCTGCAAAATGGTTAGAAAGAAACAGCTGGATTACGTT

CCTCTAAAAACCACCTGAACGTAACCTTCGCAGGGCGTCAAGTCATCTTT

TCTTGCCTTCGGCTGTGGCTTCTGTGGCTTTCCGGATTTGCACATTTCCT

GGGGTACTATGAACGTGAGTGGGGTATTTTGTTCTGGCATTAGAAGAAAA

ACAAGCAAGCAAACAAAAACACAGCCTCCGATGCCAAACATGTTCCCCCT

TCTTCACTTCCTTGGAACTGGAAGTGTTATTCCTAAGTCTAGTGCAAAAT

GCTTCTACTCTCTGTGTCTTCCTGATAGGGATGTTTAATGTAAGTAGGAT

ATTAATTTCAGAACATTGATTTCTTATCTGTGTGTCTGACGTGCCATCTT

TAATGTTAAAATTAAGGTGTTAAAATTAAGCCTAGTTATATAGACGAAAT

AAAATGCTAAGTCACTA, or a nucleic acid sequence that hybridizes to a nucleic acid sequence consisting of SEQ ID NO:26 under stringent hybridization conditions.

In some embodiments, Forhead box D4 like 3 (FOXD6) comprises the amino acid sequence (SEQ ID NO: 27; NP_954586)

MNLPRAERLRSTPQRSLRDSDGEDGKIDVLGEEEDEDEVEDEEEAASQQF

LEQSLQPGLQVARWGGVALPREHIEGGGPSDPSEFGTKFRAPPRSAAAS

EDARQPAKPPYSYIALITMAILQNPHKRLTLSGICAFISGRFPYYRRKFP

AWQNSIRHNLSLNDCFVKIPREPGHPGKGNYWSLDPASQDMFDNGSFLRR

RKRFKRHQLTPGAHLPHPFPLPAAHAALHNPRPGPLLGAPAPPQPVPGAY

PNTAPGRRPYALLHPHPLRYLLLSAPVYAGAPKKAEGAALATPAPFPCCS

PHLVLSLGRRARVWRRHREADASLSALRVLCKGSRTAPTAALPPRARCWA

GTCRPRRPC, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:27.

In some embodiments, the nucleic acid sequence encoding FOXD6 comprises the nucleic acid sequence:

(SEQ ID NO: 28; NM_199135)

CATTCATCCCAGGCTTCCAGCTCAGCCCGCCCCAGGCCAGGTGATCGGCC

GCCACATCCCCTGCGACTGAAGCACCTGCTCCTCCATGAACCTGCCAAGA

GCTGAGCGCCTTCGCTCCACACCGCAGCGCAGCCTCCGGGACTCCGATGG

GGAAGACGGTAAAATCGATGTCCTGGGAGAGGAGGAAGATGAAGACGAGG

TGGAAGACGAGGAGGAGGCGGCGAGCCAGCAGTTCCTAGAGCAGTCGCTC

CAGCCGGGGCTGCAGGTGGCCCGGTGGGGCGGGGTTGCGCTTCCCCGAGA

GCACATCGAGGGCGGCGGCGGCCCGAGCGACCCCTCAGAGTTTGGCACCA

AGTTCAGGGCACCGCCAAGGTCTGCGGCGGCCTCTGAAGATGCCCGGCAG

CCGGCAAAGCCCCCCTACTCGTACATCGCGCTCATCACCATGGCCATCCT

GCAAAACCCGCACAAGCGCCTCACGCTCAGCGGCATCTGCGCCTTCATTA

GTGGCCGCTTCCCCTACTACCGCCGCAAGTTCCCCGCCTGGCAGAACAGC

ATCCGCCACAACCTCTCGCTGAACGACTGCTTCGTTAAGATCCCCCGCGA

-continued

GCCGGGCCACCCAGGCAAGGGCAACTACTGGAGCCTGGACCCCGCCTCCC

AAGACATGTTCGACAATGGCAGCTTTCTCCGGCGTAGGAAGCGTTTCAAG

CGCCACCAACTGACCCCGGGAGCCCACCTGCCCCACCCCTTCCCTCTACC

TGCTGCACACGCCGCCCTGCACAACCCCCGCCCAGGCCCTCTGCTTGGGG

CCCCTGCCCCGCCGCAGCCAGTCCCGGGGGCCTACCCCAACACCGCCCCC

GGGAGACGCCCTTACGCTCTGCTGCACCCGCATCCTCTTCGCTACCTACT

GCTCTCGGCCCCCGTCTATGCCGGGGCACCGAAGAAAGCAGAAGGCGCGG

CCCTGGCGACCCCGGCACCCTTCCCGTGCTGCAGCCCTCACTTGGTCCTC

AGCCTTGGGAGGAGGGCAAGGGTCTGGCGTCGCCACCGGGAGGCGGATGC

ATCTCTTTCAGCATTGAGAGTATTATGCAAGGGGTCAGGGGAGCGGGTAC

AGGGGCTGCGCAGAATTTGTCCCCGACCGCGTGGAGCTACTGCCACCTGC

TCCAGCGACCATCAAGCCTGTTGCATCCCCAGACCGCTGCCCCTTTGCTG

CAAGTGTCCGCCGCCGCCGCTGCTCGGACAATTTTGCAGCAATAGCAGCA

GCATCAGGAGGAGGACTGCGCCAACGGCTGCGCTCCCACCAAGGGCGCGG

TGCTGGGCGGGCACCTGTCGGCCTCGTCGGCCCTGCTGAGGTATCAGGCA

GTGGCAGAGGGCTCTAGGCTGACATCGCTGGCTGCCCCTTTGGGCGGAGA

GGGGACCTCACCAGTTTTTTTAGTATCGCCCACGCCCAGTTCCCTGGCCA

ACTCCGCAGGGCCCTCCTAGAGCCAGGTGGGAGTGGGGAGCGACCCGCAG

CTGCTCACTCCACCTTGCGCGGCCCATACTGGGCGTGTGCATCTGAATCC

CGCTGGAGAGCAAACACGAACTTCTGTTCGCTGCAAAATGGTTAGAAAGA

AACAGCTGGATTACGTTCCTCTAAAAACCACCTGAACGTAACCTTCGCAG

GGCGTCAAGTCATCTTTTCTTGCCTTCGGTTGTGGCTTCTATGGCTGTCC

CGATTTGCGCATTTCCTGGGGTACTATGAACGTGAGTGGGGTATTTTGTT

CTGGCATTAAAAGAAAAACAAGCAAGCAAACAAAAACACAGCCTCCGATG

CCAAACATGTTCCCCCTTCTTCACTTCCTTGGAGCTGGAAGTATTATTCC

TAAGTCTAGTGCAAAATGCTTCTACTCTCTGTGTCTTCCTGATAGGGATG

TTTAATGTAAGTAGGATATTAATTTCAGAACATTGATTTCTTATCTGTGT

GTCTGACGTGCCATCTTTAATGTTAAAATTAAGGTGTTAAAATTAAGCCT

AGTTATATAGACGAAATAAAATGCTAAGTCACTACACTACATCGTTTATT

TTCTATTACATCTCATTCTTCCCTTTCTAAATGGAACTTTTTAAAACCTA

CGTTATTTTCCCTCAAACAATTTATTTTCACAATTCATATTTATTATAGA

TAGCAGAAGTAATCCATTTTAATATGGCCTTTAAAAATTCCAAATATTTG

AGGTTGAAAATGTCCTGG, or a nucleic acid sequence that hybridizes to a nucleic acid sequence consisting of SEQ ID NO:28 under stringent hybridization conditions.

In some embodiments, Forkhead box E1 (FOXE1/FOXE2) comprises the amino acid sequence:

(SEQ ID NO: 29; NP_004464)

MTAESGPPPPQPEVLATVKEERGETAAGAGVPGEATGRGAGGRRRKRPLQ

RGKPPYSYIALIAMAIAHAPERRLTLGGIYKFITERFPFYRDNPKKWQNS

-continued

IRHNLTLNDCFLKIPREAGRPGKGNYWALDPNAEDMFESGSFLRRRKRFK

RSDLSTYPAYMHDAAAAAAAAAAAAAAAAIFPGAVPAARPPYPGAVYAGY

APPSLAAPPPVYYPAASPGPCRVFGLVPERPLSPELGPAPSGPGGSCAFA

SAGAPATTTGYQPAGCTGARPANPSAYAAAYAGPDGAYPQGAGSAIFAAA

GRLAGPASPPAGGSSGGVETTVDFYGRTSPGQFGALGACYNPGGQLGGAS

AGAYHARHAAAYPGGIDRFVSAM, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:29.

In some embodiments, the nucleic acid sequence encoding FOXE1/FOXE2 comprises the nucleic acid sequence:

(SEQ ID NO: 30; NM_004473)

ATGACTGCCGAGAGCGGGCCGCCGCCGCCGCAGCCGGAGGTGCTGGCTAC

CGTGAAGGAAGAGCGCGGCGAGACGGCAGCAGGGGCCGGGGTCCCAGGGG

AGGCCACGGGCCGCGGGGCGGGCGGGCGGCGCCGCAAGCGCCCCCTGCAG

CGCGGGAAGCCGCCCTACAGCTACATCGCGCTCATCGCCATGGCCATCGC

GCACGCGCCCGAGCGCCGCCTCACGCTGGGCGGCATCTACAAGTTCATCA

CCGAGCGCTTCCCCTTCTACCGCGACAACCCCAAAAAGTGGCAGAACAGC

ATCCGCCACAACCTCACACTCAACGACTGCTTCCTCAAGATCCCGCGCGA

GGCCGGCCGCCCGGGTAAGGGCAACTACTGGGCGCTTGACCCCAACGCGG

AGGACATGTTCGAGAGCGGCAGCTTCCTGCGCCGCCGCAAGCGCTTCAAG

CGCTCGGACCTCTCCACCTACCCGGCTTACATGCACGACGCGGCGGCTGC

CGCAGCCGCCGCCGCCGCCGCCGCCGCCGCCGCCGCCATCTTCCCAGGCG

CGGTGCCCGCCGCGCGCCCCCCCTACCCGGGCGCCGTCTATGCAGGCTAC

GCGCCGCCGTCGCTGGCCGCGCCGCCTCCAGTCTACTACCCCGCGGCGTC

GCCCGGCCCTTGCCGCGTCTTCGGCCTGGTTCCTGAGCGGCCGCTCAGCC

CAGAGCTGGGGCCCGCACCGTCGGGGCCCGGCGGCTCTTGCGCCTTTGCC

TCCGCCGGGCCCCCGCTACCACCACCGGCTACCAGCCCGCAGGCTGCACC

GGGGCCCGGCCGGCCAACCCCTCCGCCTATGCGGCTGCCTACGCGGGCCC

CGACGGCGCGTACCCGCAGGGCGCCGGCAGTGCGATCTTTGCCGCTGCTG

GCCGCCTGGCGGGACCCGCTTCGCCCCCAGCGGGCGGCAGCAGTGGCGGC

GTGGAGACCACGGTGGACTTCTACGGGCGCACGTCGCCCGGCCAGTTCGG

AGCGCTGGGAGCCTGCTACAACCCTGGCGGGCAGCTCGGAGGGGCCAGTG

CAGGCGCCTACCATGCTCGCCATGCTGCCGCTTATCCCGGTGGGATAGAT

CGGTTCGTGTCCGCCATG, or a nucleic acid sequence that hybridizes to a nucleic acid sequence consisting of SEQ ID NO:30 under stringent hybridization conditions.

In some embodiments, Forkhead box E3 (FOXE3) comprises the amino acid sequence:

(SEQ ID NO: 31; NP_036318)

MAGRSDMDPPAAFSGFPALPAVAPSGPPPSPLAGAEPGREPEEAAAGRGE

AAPTPAPGPGRRRRRPLQRGKPPYSYIALIAMALAHAPGRRLTLAAIYRF

ITERFAFYRDSPRKWQNSIRHNLTLNDCFVKVPREPGNPGKGNYWTLDPA

AADMFDNGSFLRRRKRFKRAELPAHAAAAPGPPLPFPYAPYAPAPGPALL

VPPPSAGPGPSPPARLFSVDSLVNLQPELAGLGAPEPPCCAAPDAAAAAF

PPCAAAASPPLYSQVPDRLVLPATRPGPGPLPAEPLLALAGPAAALGPLS

PGEAYLRQPGFASGLERYL, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:31.

In some embodiments, the nucleic acid sequence encoding FOXE3 comprises the nucleic acid sequence:

(SEQ ID NO: 32; NM_012186)

ATGGCGGGGCGCAGCGACATGGATCCGCCCGCCGCGTTCTCTGGCTTCC

CTGCCCTGCCAGCGGTCGCGCCGTCGGGGCCGCCGCCGTCGCCGCTCGC

AGGAGCCGAGCCAGGGCGGGAGCCAGAGGAGGCGGCGGCTGGCCGCGGA

GAGGCGGCCCCCACGCCCGCGCCCGGCCCGGGGCGGCGGCGGCGGC

CCCTGCAGCGCGGGAAGCCGCCCTACTCGTACATCGCGCTCATCGCCAT

GGCTCTGGCGCACGCCCCGGGCCGCCGCCTCACGCTGGCCGCCATCTAC

CGCTTCATCACCGAACGCTTTGCCTTCTACCGCGACAGCCCGCGCAAGT

GGCAGAACAGCATCCGCCACAATCTCACGCTCAACGACTGCTTCGTCAA

GGTGCCCCGCGAGCCGGGCAACCCGGGCAAGGGCAACTACTGGACGCTG

GACCCCGCGGCCGCAGACATGTTCGACAACGGCAGCTTCCTGCGGCGCC

GCAAGCGCTTCAAGCGCGCCGAGCTGCCCGCGCACGCGGCCGCGGCGCC

AGGGCCGCCGCTCCCCTTCCCCTACGCGCCCTACGCGCCCGCGCCCGGC

CCCGCGCTGCTGGTGCCGCCGCCTTCTGCCGGACCGGGCCCCTCGCCGC

CCGCGCGTCTGTTCAGCGTCGACAGCCTGGTGAACCTGCAGCCGGAGCT

AGCGGGGCTGGGCGCCCCCGAGCCGCCCTGCTGCGCCGCGCCCGACGCC

GCAGCCGCAGCCTTCCCGCCCTGCGCTGCCGCCGCCTCCCCGCCACTCT

ACTCGCAGGTCCCCGACCGCCTGGTACTGCCCGCGACGCGCCCCGGCCC

CGGCCCGCTGCCCGCTGAGCCCCTCCTGGCCTTGGCCGGGCCGGCAGCC

GCTCTCGGCCCGCTCAGCCCTGGGGAGGCCTACCTGAGGCAGCCGGGCT

TCGCGTCGGGGCTGGAGCGCTACCTG, or a nucleic acid sequence that hybridizes to a nucleic acid sequence consisting of SEQ ID NO:32 under stringent hybridization conditions.

In some embodiments, Forkhead box G1 (FOXG1) comprises the amino acid sequence:

(SEQ ID NO: 33; NP_005240)

MLDMGDRKEVKMIPKSSFSINSLVPEAVQNDNHHASHGHHNSHHPQHHH

HHHHHHHHPPPPAPQPPPPPQQQQPPPPPPPAPQPPQTRGAPAADDDKG

PQQLLLPPPPPPPPAAALDGAKAVGLGGKGEPGGGPGELAPVGPDEKEK

GAGAGGEEKKGAGEGGKDGEGGKEGEKKNGKYEKPPFSYNALIMMAIRQ

SPEKRLTLNGIYEFIMKNFPYYRENKQGWQNSIRHNLSLNMCFVKVPRH

YDDPGKGNYWMLDPSSDDVFIGGTTGKLRRRSTTSRAKLAFKRGARLTS

TGLTFMDRAGSLYWPMSPFLSLHHPRASSTLSYNGTTSAYPSHPMPYSS

VLTQNSLGNNHSFSTANGLSVDRLVNGEIPYATHHLTAAALAASVPCGL

SVPCSGTYSLNPCSVNLLAGQTSYFFPHVPHPSMTSQSSTSMSARATSS

STSPQAPSTLPCESLRPSLPSFTTGLSGGLSDYFTHQNQGSSSNPLIH, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:33.

In some embodiments, the nucleic acid sequence encoding FOXG1 comprises the nucleic acid sequence:

(SEQ ID NO: 34; NM_005249)

ATGCTGGACATGGGAGATAGGAAAGAGGTGAAAATGATCCCCAAGTCCT

CGTTCAGCATCAACAGCCTGGTGCCCGAGGCGGTCCAGAACGACAACCA

CCACGCGAGCCACGGCCACCACAACAGCCACCACCCCCAGCACCACCAC

CACCACCACCACCATCACCACCACCCGCCGCCGCCCGCCCCGCAACCGC

CGCCGCCGCCGCAGCAGCAGCAGCCGCCGCCGCCGCCGCCCCCGGCACC

GCAGCCCCCCCAGACGCGGGGCGCCCCGGCCGCCGACGACGACAAGGGC

CCCCAGCAGCTGCTGCTCCCGCCGCCGCCACCGCCACCACCGGCCGCCG

CCCTGGACGGGGCTAAAGCGGTCGGGCTGGGCGGCAAGGGCGAGCCGGG

CGGCGGGCCGGGGGAGCTGGCGCCCGTCGGGCCGGACGAGAAGGAGAAG

GGCGCCGGCGCCGGGGGGGAGGAGAAGAAGGGGGCGGGCGAGGGCGGCA

AGGACGGGGAGGGGGGCAAGGAGGGCGAGAAGAAGAACGGCAAGTACGA

GAAGCCGCCGTTCAGCTACAACGCGCTCATCATGATGGCCATCCGGCAG

AGCCCCGAGAAGCGGCTCACGCTCAACGGCATCTACGAGTTCATCATGA

AGAACTTCCCTTACTACCGCGAGAACAAGCAGGGCTGGCAGAACTCCAT

CCGCCACAATCTGTCCCTCAACATGTGCTTCGTGAAGGTGCCGCGCCAC

TACGACGACCCGGGCAAGGGCAACTACTGGATGCTGGACCCGTCGAGCG

ACGACGTGTTCATCGGCGGCACCACGGGCAAGCTGCGGCGCCGCTCCAC

CACCTCGCGGGCCAAGCTGGCCTTCAAGCGCGGTGCGCGCCTCACCTCC

ACCGGCCTCACCTTCATGGACCGCGCCGGCTCCCTCTACTGGCCCATGT

CGCCCTTCCTGTCCCTGCACCACCCCCGCGCCAGCAGCACTTTGAGTTA

CAACGGCACCACGTCGGCCTACCCCAGCCACCCCATGCCCTACAGCTCC

GTGTTGACTCAGAACTCGCTGGGCAACAACCACTCCTTCTCCACCGCCA

-continued

ACGGCCTGAGCGTGGACCGGCTGGTCAACGGGGAGATCCCGTACGCCAC

GCACCACCTCACGGCCGCCGCGCTAGCCGCCTCGGTGCCCTGCGGCCTG

TCGGTGCCCTGCTCTGGGACCTACTCCCTCAACCCCTGCTCCGTCAACC

TGCTCGCGGGCCAGACCAGTTACTTTTTCCCCCACGTCCCGCACCCGTC

AATGACTTCGCAGAGCAGCACGTCCATGAGCGCCAGGGCCACGTCCTCC

TCCACGTCGCCGCAGGCCCCCTCGACCCTGCCCTGTGAGTCTTTAAGAC

CCTCTTTGCCAAGTTTTACGACGGGACTGTCTGGGGGACTGTCTGATTA

TTTCACACATCAAAATCAGGGGTCTTCTTCCAACCCTTTAATACAT, or a nucleic acid sequence that hybridizes to a nucleic acid sequence consisting of SEQ ID NO:34 under stringent hybridization conditions.

In some embodiments, Forhead box H1 (FOXH1) comprises the amino acid sequence:

(SEQ ID NO: 35; NP_003914)

MGPCSGSRLGPPEAESPSQPPKRRKKRYLRHDKPPYTYLAMIALVIQAA

PSRRLKLAQIIRQVQAVFPFFREDYEGWKDSIRHNLSSNRCFRKVPKDP

AKPQAKGNFWAVDVSLIPAEALRLQNTALCRRWQNGGARGAFAKDLGPY

VLHGRPYRPPSPPPPPSEGFSIKSLLGGSGEGAPWPGLAPQSSPVPAGT

GNSGEEAVPTPPLPSSERPLWPLCPLPGPTRVEGETVQGGAIGPSTLSP

EPRAWPLHLLQGTAVPGGRSSGGHRASLWGQLPTSYLPIYTPNVVMPLA

PPPTSCPQCPSTSPAYWGVAPETRGPPGLLCDLDALFQGVPPNKSIYDV

WVSHPRDLAAPGPGWLLSWCSL, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:35.

In some embodiments, the nucleic acid sequence encoding FOXH1 comprises the nucleic acid sequence:

(SEQ ID NO: 36; NM_003923)

ATGGGGCCCTGCAGCGGCTCCCGCCTGGGGCCCCCAGAGGCAGAGTC

GCCCTCCCAGCCCCCTAAGAGGAGGAAGAAGAGGTACCTGCGACATGAC

AAGCCCCCCTACACCTACTTGGCCATGATCGCCTTGGTGATTCAGGCCG

CTCCCTCCCGCAGACTGAAGCTGGCCCAGATCATCCGTCAGGTCCAGGC

CGTGTTCCCCTTCTTCAGGGAAGACTACGAGGGCTGGAAAGACTCCATT

CGCCACAACCTTTCCTCCAACCGATGCTTCCGCAAGGTGCCCAAGGACC

CTGCAAAGCCCCAGGCCAAGGGCAACTTCTGGGCGGTCGACGTGAGCCT

GATCCCAGCTGAGGCGCTCCGGCTGCAGAACACCGCCCTGTGCCGGCGC

TGGCAGAACGGAGGTGCGCGTGGAGCCTTCGCCAAGGACCTGGGCCCCT

ACGTGCTGCACGGCCGGCCATACCGGCCGCCCAGTCCCCCGCCACCACC

CAGTGAGGGCTTCAGCATCAAGTCCCTGCTAGGAGGGTCCGGGGAGGGG

GCACCCTGGCCGGGGCTAGCTCCACAGAGCAGCCCAGTTCCTGCAGGCA

CAGGGAACAGTGGGGAGGAGGCGGTGCCCACCCCACCCCTTCCCTCTTC

TGAGAGGCCTCTGTGGCCCCTCTGCCCCCTTCCTGGCCCCACGAGAGTG

-continued

GAGGGGGAGACTGTGCAGGGGGGAGCCATCGGGCCCTCAACCCTCTCCC

CAGAGCCTAGGGCCTGGCCTCTCCACTTACTGCAGGGCACCGCAGTTCC

TGGGGGACGGTCCAGCGGGGGACACAGGGCCTCCCTCTGGGGGCAGCTG

CCCACCTCCTACTTGCCTATCTACACTCCCAATGTGGTAATGCCCTTGG

CACCACCACCCACCTCCTGTCCCCAGTGTCCGTCAACCAGCCCTGCCTA

CTGGGGGGTGGCCCCTGAAACCCGAGGGCCCCCAGGGCTGCTCTGCGAT

CTAGACGCCCTCTTCCAAGGGGTGCCACCCAACAAAAGCATCTACGACG

TTTGGGTCAGCCACCCTCGGGACCTGGCGGCCCCTGGCCCAGGCTGGCT

GCTCTCCTGGTGCAGCCTG, or a nucleic acid sequence that hybridizes to a nucleic acid sequence consisting of SEQ ID NO:36 under stringent hybridization conditions.

In some embodiments, Forkheadbox 11 (FOXI1) comprises the amino acid sequence:

(SEQ ID NO: 37; NP_036320)

MSSFDLPAPSPPRCSPQFPSIGQEPPEMNLYYENFFHPQGVPSPQRPSF

EGGGEYGATPNPYLWFNGPTMTPPPYLPGPNASPFLPQAYGVQRPLLPS

VSGLGGSDLGWLPIPSQEELMKLVRPPYSYSALIAMAIHGAPDKRLTLS

QIYQYVADNFPFYNKSKAGWQNSIRHNLSLNDCFKKVPRDEDDPGKGNY

WTLDPNCEKMFDNGNFRRKRKRKSDVSSSTASLALEKTESSLPVDSPKT

TEPQDILDGASPGGTTSSPEKRPSPPPSGAPCLNSFLSSMTAYVSGGSP

TSHPLVTPGLSPEPSDKTGQNSLTFNSFSPLTNLSNHSGGGDWANPMPT

NMLSYGGSVLSQFSPHFYNSVNTSGVLYPREGTEV, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:37

In some embodiments, the nucleic acid sequence encoding FOXI1 comprises the nucleic acid sequence:

(SEQ ID NO: 38; NM_012188)

ATGAGCTCCTTCGACCTGCCGGCGCCCTCCCCACCTCGCTGCAGCCCCC

AGTTCCCCAGCATCGGCCAGGAGCCCCCCGAGATGAACCTCTACTATGA

GAACTTCTTCCACCCACAGGGCGTGCCCAGCCCTCAGCGGCCCTCCTTC

GAGGGGGGCGGCGAGTATGGGGCCACCCCCAACCCCTACCTCTGGTTCA

ACGGGCCCACCATGACCCCGCCACCCTACCTGCCCGGCCCCAACGCCAG

CCCCTTCCTGCCCCAGGCCTATGGAGTGCAGAGACCGCTGCTGCCCAGC

GTGTCGGGGCTTGGGGGGAGCGACCTGGGCTGGCTGCCCATCCCCTCGC

AGGAGGAGCTGATGAAGCTGGTGCGGCCACCCTATTCCTACTCGGCTCT

CATCGCCATGGCCATCCACGGGGCACCCGACAAGCGCCTCACTCTCAGC

CAGATCTACCAGTACGTGGCCGACAACTTCCCCTTCTACAACAAGAGCA

AGGCCGGCTGGCAGAACTCCATCCGCCACAACCTGTCGCTCAACGACTG

CTTCAAGAAGGTGCCCCGCGACGAGGACGACCCGGGCAAAGGGAATTAC

-continued

TGGACCCTGGACCCCAACTGTGAGAAAATGTTCGACAATGGAAATTTCC

GCAGGAAAAGGAAGAGAAAATCAGATGTTTCCTCTAGCACAGCCTCCTT

GGCCTTAGAGAAGACAGAGAGCAGTCTCCCGGTGGACAGCCCCAAGACC

ACGGAGCCTCAGGACATCTTGGATGGAGCCTCACCAGGGGGCACCACCA

GCTCCCCAGAGAAGCGGCCCTCCCCTCCCCCATCAGGCGCCCCTTGCCT

TAACAGCTTCCTTTCCTCTATGACAGCCTATGTGAGCGGGGGGAGCCCC

ACGAGCCACCCCTTGGTCACACCAGGACTGAGCCCTGAGCCCAGTGACA

AGACGGGGCAGAACTCACTGACCTTCAACTCCTTCTCCCCGCTCACCAA

CCTCAGCAACCACAGCGGTGGGGGTGACTGGGCGAACCCCATGCCCACC

AACATGCTCAGCTACGGAGGATCTGTGCTCAGCCAATTCAGCCCTCACT

TCTACAACAGTGTCAACACCAGTGGTGTCCTCTACCCCAGGGAGGGCAC

CGAGGTC, or a nucleic acid sequence that hybridizes to a nucleic acid sequence consisting of SEQ ID NO:38 under stringent hybridization conditions.

In some embodiments, Forhead box J1 (FOXJ1) comprises the amino acid sequence:

(SEQ ID NO: 39; NP_001445)

MAESWLRLSGAGPAEEAGPEGGLEEPDALDDSLTSLQWLQEFSILNAKA

PALPPGGTDPHGYHQVPGSAAPGSPLAADPACLGQPHTPGKPTSSCTSR

SAPPGLQAPPPDDVDYATNPHVKPPYYATLICMAMQASKATKITLSAIY

KWITDNFCYFRHADPTWQNSIRHNLSLNKCFIKVPREKDEPGKGGFWRI

DPQYAERLLSGAFKKRRLPPVHIHPAFARQAAQEPSAVPRAGPLTVNTE

AQQLLREFEEATGEAGWGAGEGRLGHKRKQPLPKRVAKVPRPPSTLLPT

PEEQGELEPLKGNFDWEAIFDAGTLGGELGALEALELSPPLSPASHVDV

DLTIHGRHIDCPATWGPSVEQAADSLDFDETFLATSFLQHPWDESGSGC

LPPEPLFEAGDATLASDLQDWASVGAFL, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:39.

In some embodiments, the nucleic acid sequence encoding FOXJ1 comprises the nucleic acid sequence:

(SEQ ID NO: 40; NM_001454)

ATGGCGGAGAGCTGGCTGCGCCTCTCGGGAGCCGGGCCGGCGGAGGAGG

CCGGGCCGGAGGGCGGCCTGGAGGAGCCCGACGCCCTGGATGACAGCCT

GACCAGCCTGCAGTGGCTGCAGGAATTCTCCATTCTCAACGCCAAGGCC

CCCGCCCTGCCCCCGGGGGGCACCGACCCCCACGGCTACCACCAGGTGC

CAGGTTCAGCGGCGCCCGGGTCCCCCCTGGCGGCCGACCCCGCCTGCCT

GGGGCAGCCACACACGCCGGGCAAGCCCACGTCGTCGTGCACGTCGCGG

AGCGCGCCCCCGGGGCTGCAGGCCCCACCCCCCGACGACGTGGACTACG

CCACCAATCCGCACGTGAAGCCTCCCTACTCGTATGCCACGCTCATCTG

CATGGCCATGCAGGCCAGCAAGGCCACCAAGATCACCCTGTCGGCCATC

-continued

TACAAGTGGATCACGGACAACTTCTGCTACTTCCGCCACGCAGATCCCA

CCTGGCAGAATTCAATCCGCCACAACCTGTCTCTGAACAAGTGCTTCAT

CAAAGTGCCTCGGGAGAAGGACGAACCAGGCAAGGGGGGCTTCTGGCGC

ATTGACCCCCAGTACGCGGAGCGGCTACTGAGCGGCGCTTTCAAGAAGC

GGCGACTGCCCCCTGTCCACATCCACCCAGCCTTTGCCCGCCAGGCCGC

GCAGGAGCCCAGCGCTGTCCCCCGGGCCGGGCCGCTGACGGTGAATACC

GAGGCCCAGCAGCTGCTGCGGGAGTTCGAGGAGGCCACCGGGGAGGCGG

GCTGGGGTGCAGGCGAGGGCAGGCTGGGGCATAAGCGCAAACAGCCGCT

GCCCAAGCGGGTGGCCAAGGTCCCGCGGCCCCCCAGCACCCTGCTGCCC

ACCCCGGAGGAGCAGGGTGAGCTGGAACCCCTCAAAGGCAACTTTGACT

GGGAGGCCATCTTCGACGCCGGCACTCTGGGCGGGGAGCTGGGTGCACT

GGAGGCCCTGGAGCTGAGCCCGCCTCTGAGCCCCGCCTCACACGTGGAC

GTGGACCTCACCATCCACGGCCGCCACATCGACTGCCCTGCCACCTGGG

GGCCTTCGGTGGAGCAGGCTGCCGACAGCCTGGACTTCGATGAGACCTT

CCTGGCCACATCCTTCCTGCAGCACCCCTGGGACGAGAGCGGCAGTGGC

TGCCTGCCCCCGGAGCCCCTCTTTGAGGCTGGGGATGCCACCCTGGCCT

CCGACCTGCAGGACTGGGCCAGCGTGGGGGCCTTCTTG, or a nucleic acid sequence that hybridizes to a nucleic acid sequence consisting of SEQ ID NO:40 under stringent hybridization conditions.

In some embodiments, Forkhead box K1 (FOXK1) comprises the amino acid sequence:

(SEQ ID NO: 41; NP_001032242)

MAEVGEDSGARALLALRSAPCSPVLCAAAAAAAFPAAAPPPAPAQPQPP

PGPPPPPPPPLPPGAIAGAGSSGGSSGVSGDSAVAGAAPALVAAAAASV

RQSPGPALARLEGREFEFLMRQPSVTIGRNSSQGSVDLSMGLSSFISRR

HLQLSFQEPHFYLRCLGKNGVFVDGAFQRRGAPALQLPKQCTFRFPSTA

IKIQFTSLYHKEEAPASPLRPLYPQISPLKIHIPEPDLRSMVSPVPSPT

GTISVPNSCPASPRGAGSSSYRFVQNVTSDLQLAAEFAAKAASEQQADT

SGGDSPKDESKPPFSYAQLIVQAISSAQDRQLTLSGIYAHITKHYPYYR

TADKGWQNSIRHNLSLNRYFIKVPRSQEEPGKGSFWRIDPASEAKLVEQ

AFRKRRQRGVSCFRTPFGPLSSRSAPASPTHPGLMSPRSGGLQTPECLS

REGSPIPHDPEFGSKLASVPEYRYSQSAPGSPVSAQPVIMAVPPRPSSL

VAKPVAYMPASIVTSQQPAGHAIHVVQQAPTVTMVRVVTTSANSANGYI

LTSQGAAGGSHDAAGAAVLDLGSEARGLEEKPTIAFATIPAAGGVIQTV

ASQMAPGVPGHTVTILQPATPVTLGQHHLPVRAVTQNGKHAVPTNSLAG

NAYALTSPLQLLATQASSSAPVVVTRVCEVGPKEPAAAVAATATTTPAT

ATTASASASSTGEPEVKRSRVEEPSGAVTTPAGVIAAAGPQGPGTGE, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:41.

In some embodiments, the nucleic acid sequence encoding FOXK1 comprises the nucleic acid sequence:

(SEQ ID NO: 42; NM_001037165)
ATGGCCGAAGTCGGCGAGGACAGCGGCGCCCGCGCCCTGCTCGCGCTGC
GCTCGGCGCCCTGCAGCCCAGTGCTGTGCGCCGCAGCCGCCGCCGCCGC
CTTCCCCGCGGCCGCACCCCCGCCGGCCCCCGCGCAGCCCCAGCCTCCG
CCCGGGCCGCCGCCGCCGCCGCCACCGCCGCTGCCTCCGGGCGCGATCG
CGGGCGCGGGCTCCTCCGGGGGCTCCTCCGGGGTATCCGGGGACTCCGC
GGTCGCGGGCGCGGCGCCGGCCCTGGTGGCCGCGGCGGCCGCCTCGGTA
CGGCAGAGCCCGGGGCCGGCGCTGGCGCGGCTGGAGGGCCGCGAGTTCG
AGTTCCTCATGCGCCAGCCCAGCGTCACCATCGGCCGCAACTCGTCGCA
GGGCTCGGTGGACTTGAGCATGGGCCTGTCCAGCTTCATCTCGCGGCGC
CACCTGCAGCTCAGCTTCCAGGAGCCGCACTTCTACCTGCGCTGCCTCG
GCAAGAACGGCGTCTTCGTGGACGGGGCCTTCCAGAGACGCGGCGCGCC
CGCCCTGCAGCTGCCCAAGCAGTGTACCTTCCGGTTTCCCAGCACGGCC
ATCAAGATCCAGTTCACGTCGCTCTATCACAAAGAAGAGGCCCCAGCCT
CCCCGCTGCGGCCACTGTACCCCCAGATCTCCCCTCTGAAGATCCACAT
CCCGGAGCCGGACCTCCGGAGCATGGTCAGCCCCGTCCCCTCCCCGACG
GGCACCATCAGTGTCCCCAACTCCTGCCCAGCCAGTCCACGCGGTGCCG
GCTCCTCCAGTTACCGCTTTGTGCAGAACGTGACCTCGGACCTGCAGCT
GGCAGCAGAGTTTGCAGCAAAGGCCGCGTCGGAGCAGCAGGCAGACACG
TCTGGAGGAGACAGCCCCAAGGATGAGTCAAAGCCGCCGTTCTCCTACG
CGCAGCTGATCGTGCAGGCCATCTCCTCCGCCCAGGACCGGCAGCTGAC
CCTGAGCGGGATCTACGCCCACATCACCAAGCATTACCCCTACTACCGG
ACGGCCGACAAAGGCTGGCAGAATTCTATCCGGCACAACCTCTCTTTGA
ACCGTTACTTTATCAAAGTCCCACGTTCCCAGGAGGAGCCTGGGAAGGG
GTCCTTTTGGCGAATAGACCCTGCCTCTGAAGCCAAGCTCGTGGAACAG
GCATTCCGGAAACGGAGGCAGAGGGGTGTCTCCTGCTTCCGCACCCCCT
TCGGGCCTCTGTCCTCAAGGAGCGCTCCAGCTTCGCCCACACACCCCGG
GCTGATGTCCCCTCGCTCCGGCGGCCTGCAGACCCCAGAGTGCCTGTCT
CGGGAGGGCTCCCCCATTCCACACGACCCTGAGTTTGGGTCCAAGTTAG
CTTCTGTCCCAGAGTACCGGTATTCCCAAAGCGCACCCGGCTCCCCCGT
CAGCGCCCAGCCAGTGATCATGGCCGTGCCTCCCCGACCGTCCAGCCTC
GTGGCCAAGCCCGTGGCCTACATGCCCGCCTCCATCGTAACCTCACAGC
AGCCCGCGGGCCACGCCATCCACGTCGTGCAGCAGGCCCCCACCGTCAC
CATGGTCAGGGTGGTCACCACATCTGCCAACTCGGCCAACGGATACATC
CTCACCAGCCAGGGCGCGGCGGGGGGCTCCCATGATGCGGCGGGCGCAG
CCGTGCTGGACCTGGGCAGCGAGGCCAGAGGCCTGGAGGAGAAACCCAC
CATTGCGTTTGCCACAATCCCCGCGGCTGGTGGAGTCATCCAGACGGTG
GCCAGCCAGATGGCCCCCGGGGTCCCCGGACACACGGTCACCATCCTGC
AGCCCGCCACACCCGTGACCCTCGGGCAGCACCACCTTCCAGTCCGGGC

-continued

CGTGACCCAGAACGGAAAGCATGCGGTTCCCACGAACAGTTTAGCCGGC
AACGCTTACGCCCTCACCAGCCCTTTGCAGCTCCTTGCGACCCAAGCGA
GTTCATCCGCGCCGGTGGTGGTCACCCGGGTGTGCGAGGTGGGGCCCAA
GGAGCCAGCAGCAGCCGTCGCGGCCACGGCCACCACCACCCCAGCCACT
GCCACCACCGCCTCTGCCTCCGCCTCTTCCACTGGAGAGCCCGAGGTCA
AAAGGTCCCGGGTGGAGGAGCCCAGTGGGGCTGTAACCACACCGGCTGG
AGTGATCGCAGCTGCCGGCCCCCAGGGGCCAGGCACCGGGGAG, or a nucleic acid sequence that hybridizes to a nucleic acid sequence consisting of SEQ ID NO:42 under stringent hybridization conditions.

In some embodiments, Forkhead box L1 (FOXL1) comprises the amino acid sequence:

(SEQ ID NO: 43; NP_005241)
MSHLFDPRLPALAASPMLYLYGPERPGLPLAFAPAAALAASGRAETPQK
PPYSYIALIAMAIQDAPEQRVTLNGIYQFIMDRFPFYHDNRQGWQNSIR
HNLSLNDCFVKVPREKGRPGKGSYWTLDPRCLDMFENGNYRRRKRKPKP
GPGAPEAKRPRAETHQRSAEAQPEAGSGAGGSGPAISRLQAAPAGPSPL
LDGPSPPAPLHWPGTASPNEDAGDAAQGAAAVAVGQAARTGDGPGSPLR
PASRSSPKSSDKSKSFSIDSILAGKQGQKPPSGDELLGGAKPGPGGRLG
ASLLAASSSLRPPFNASLMLDPHVQGGFYQLGIPFLSYFPLQVPDTVLH
FQ, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:43.

In some embodiments, the nucleic acid sequence encoding FOXL1 comprises the nucleic acid sequence:

(SEQ ID NO: 44; NM_005250)
ATGAGTCACCTCTTCGATCCCCGGCTGCCTGCCCTGGCCGCCTCGCCCA
TGCTGTATCTGTACGGTCCCGAGAGACCCGGCCTCCCTCTGGCCTTCGC
CCCCGCGGCTGCTCTAGCTGCCTCGGGCCGGGCCGAGACCCCGCAGAAG
CCTCCCTACAGCTACATCGCGCTCATCGCCATGGCGATCCAGGACGCGC
CCGAGCAGAGGGTCACGCTCAACGGCATCTACCAGTTCATCATGGACCG
CTTCCCCTTCTACCACGACAACCGGCAGGGCTGGCAGAACAGCATCCGC
CACAACCTCTCGCTCAACGACTGCTTCGTCAAGGTGCCCCGCGAGAAAG
GGCGGCCGGGCAAGGGCAGCTACTGGACGCTGGACCCCCGCTGCCTGGA
CATGTTTGAGAACGGCAACTACCGGCGCCGGAAGAGGAAGCCCAAGCCG
GGCCCCGGGGCCCCGGAGGCCAAGAGGCCCCGCGCCGAGACGCACCAGC
GCAGCGCGGAGGCGCAGCCGGAGGCGGGGAGCGGGGCAGGGGGCTCGGG
CCCCGCAATCTCCCGCCTGCAGGCAGCGCCCGCGGGCCCCTCGCCCCTC
CTGGACGGCCCCTCTCCGCCGGCGCCCCTCCACTGGCCGGGGACCGCGT
CCCCGAACGAGGACGCTGGTGACGCTGCCCAGGGCGCAGCGGCCGTGGC
GGTCGGCCAGGCAGCGCGCACAGGGGACGGCCCGGGGTCCCCTCTGCGC

-continued

CCCGCCTCCCGCAGCTCTCCGAAGAGCTCCGACAAGTCCAAGAGCTTCA

GCATAGACAGCATCCTGGCGGGAAAGCAGGGCCAGAAGCCGCCTTCAGG

GGACGAACTCCTAGGGGGTGCCAAGCCTGGGCCCGGCGGCCGTCTGGGT

GCCTCGCTCCTGGCCGCCTCCTCCAGCCTCCGTCCGCCTTTCAACGCTT

CCCTGATGCTCGACCCGCATGTCCAGGGCGGCTTTTACCAGCTCGGGAT

CCCCTTCCTCTCTTATTTCCCCCTGCAGGTTCCCGACACGGTACTCCAC

TTCCAG, or a nucleic acid sequence that hybridizes to a nucleic acid sequence consisting of SEQ ID NO:44 under stringent hybridization conditions.

In some embodiments, Forkhead box L2 (FOXL2) comprises the amino acid sequence (SEQ ID NO: 45; NP_075555)

MMASYPEPEDAAGALLAPETGRTVKEPEGPPPSPGKGGGGGGGTAPEKP

DPAQKPPYSYVALIAMAIRESAEKRLTLSGIYQYIIAKFPFYEKNKKGW

QNSIRHNLSLNECFIKVPREGGGERKGNYWTLDPACEDMFEKGNYRRRR

RMKRPFRPPPAHFQPGKGLFGAGGAAGGCGVAGAGADGYGYLAPPKYLQ

SGFLNNSWPLPQPPSPMPYASCQMAAAAAAAAAAAAAAGPGSPGAAAVV

KGLAGPAASYGPYTRVQSMALPPGVVNSYNGLGGPPAAPPPPPHPHPHP

HAHHLHAAAAPPPAPPHHGAAAPPPGQLSPASPATAAPPAPAPTSAPGL

QFACARQPELAMMHCSYWDHDSKTGALHSRLDL, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:45.

In some embodiments, the nucleic acid sequence encoding FOXL2 comprises the nucleic acid sequence:

(SEQ ID NO: 46; NM_023067)

ATGATGGCCAGCTACCCCGAGCCCGAGGACGCGGCGGGGGCCCTGCTGG

CCCCAGAGACCGGTCGCACAGTCAAGGAGCCAGAAGGGCCGCCGCCGAG

CCCAGGCAAGGGCGGTGGGGGTGGCGGCGGGACAGCCCCGGAGAAGCCG

GACCCGGCGCAGAAGCCCCCGTACTCGTACGTGGCGCTCATCGCCATGG

CGATCCGCGAGAGCGCGGAGAAGAGGCTCACGCTGTCCGGCATCTACCA

GTACATCATCGCGAAGTTCCCGTTCTACGAGAAGAATAAGAAGGGCTGG

CAAAATAGCATCCGCCACAACCTCAGCCTCAACGAGTGCTTCATCAAGG

TGCCGCGCGAGGGCGGCGGCGAGCGCAAGGGCAACTACTGGACGCTGGA

CCCGGCCTGCGAAGACATGTTCGAGAAGGGCAACTACCGGCGCCGCCGC

CGCATGAAGAGGCCCTTCCGGCCGCCGCCCGCGCACTTCCAGCCCGGCA

AGGGGCTCTTCGGGGCCGGAGGCGCCGCAGGCGGGTGCGGCGTGGCGGG

CGCCGGGGCCGACGGCTACGGCTACCTGGCGCCCCCCAAGTACCTGCAG

TCTGGCTTCCTCAACAACTCGTGGCCGCTACCGCAGCCTCCCTCACCCA

TGCCCTATGCCTCCTGCCAGATGGCGGCAGCCGCAGCGGCTGCAGCAGC

-continued

TGCGGCTGCAGCCGCGGGCCCCGGTAGCCCTGGCGCGGCCGCTGTGGTC

AAGGGGCTGGCGGGCCCGGCCGCCTCGTACGGGCCGTACACACGCGTGC

AGAGCATGGCGCTGCCCCCCGGCGTAGTGAACTCGTACAATGGCCTGGG

AGGCCCGCCGGCCGCACCCCCGCCTCCGCCGCACCCCCACCCGCATCCG

CACGCACACCATCTGCACGCGGCCGCCGCACCGCCGCCTGCCCCACCGC

ACCACGGGGCCGCCGCGCCGCCGCCGGGCCAGCTCAGCCCTGCCAGCCC

AGCCACCGCCGCGCCCCCGGCGCCCGCGCCCACCAGTGCGCCGGGCCTG

CAGTTCGCTTGTGCCCGGCAGCCCGAGCTCGCCATGATGCATTGCTCTT

ACTGGGACCACGACAGCAAGACCGGCGCGCTGCATTCGCGCCTCGATCT

C, or a nucleic acid sequence that hybridizes to a nucleic acid sequence consisting of SEQ ID NO:46 under stringent hybridization conditions.

In some embodiments, Forhead box M1 (FOXM1) comprises the amino acid sequence:

(SEQ ID NO: 47; NP_068772)

MKTSPRRPLILKRRRLPLPVQNAPSETSEEEPKRSPAQQESNQAEASKE

VAESNSCKFPAGIKIINHPTMPNTQVVAIPNNANIHSIITALTAKGKES

GSSGPNKFILISCGGAPTQPPGLRPQTQTSYDAKRTEVTLETLGPKPAA

RDVNLPRPPGALCEQKRETCADGEAAGCTINNSLSNIQWLRKMSSDGLG

SRSIKQEMEEKENCHLEQRQVKVEEPSRPSASWQNSVSERPPYSYMAMI

QFAINSTERKRMTLKDIYTWIEDHFPYFKHIAKPGWKNSIRHNLSLHDM

FVRETSANGKVSFWTIHPSANRYLTLDQVFKPLDPGSPQLPEHLESQQK

RPNPELRRNMTIKTELPLGARRKMKPLLPRVSSYLVPIQFPVNQSLVLQ

PSVKVPLPLAASLMSSELARHSKRVRIAPKVLLAEEGIAPLSSAGPGKE

EKLLFGEGFSPLLPVQTIKEEEIQPGEEMPHLARPIKVESPPLEEWPSP

APSFKEESSHSWEDSSQSPTPRPKKSYSGLRSPTRCVSEMLVIQHRERR

ERSRSRRKQHLLPPCVDEPELLFSEGPSTSRWAAELPFPADSSDPASQL

SYSQEVGGPFKTPIKETLPISSTPSKSVLPRTPESWRLTPPAKVGGLDF

SPVQTSQGASDPLPDPLGLMDLSTTPLQSAPPLESPQRLLSSEPLDLIS

VPFGNSSPSDIDVPKPGSPEPQVSGLAANRSLTEGLVLDTMNDSLSKIL

LDISFPGLDEDPLGPDNINWSQFIPELQ, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:47.

In some embodiments, the nucleic acid sequence encoding FOXM1 comprises the nucleic acid sequence:

(SEQ ID NO: 48; NM_021953)

ATGAAAACTAGCCCCCGTCGGCCACTGATTCTCAAAAGACGGAGGCTGC

CCCTTCCTGTTCAAAATGCCCCAAGTGAAACATCAGAGGAGGAACCTAA

GAGATCCCCTGCCCAACAGGAGTCTAATCAAGCAGAGGCCTCCAAGGAA

GTGGCAGAGTCCAACTCTTGCAAGTTTCCAGCTGGGATCAAGATTATTA

-continued

ACCACCCCACCATGCCCAACACGCAAGTAGTGGCCATCCCCAACAATGC

TAATATTCACAGCATCATCACAGCACTGACTGCCAAGGGAAAAGAGAGT

GGCAGTAGTGGGCCCAACAAATTCATCCTCATCAGCTGTGGGGGAGCCC

CAACTCAGCCTCCAGGACTCCGGCCTCAAACCCAAACCAGCTATGATGC

CAAAAGGACAGAAGTGACCCTGGAGACCTTGGGACCAAAACCTGCAGCT

AGGGATGTGAATCTTCCTAGACCACCTGGAGCCCTTTGCGAGCAGAAAC

GGGAGACCTGTGCAGATGGTGAGGCAGCAGGCTGCACTATCAACAATAG

CCTATCCAACATCCAGTGGCTTCGAAAGATGAGTTCTGATGGACTGGGC

TCCCGCAGCATCAAGCAAGAGATGGAGGAAAAGGAGAATTGTCACCTGG

AGCAGCGACAGGTTAAGGTTGAGGAGCCTTCGAGACCATCAGCGTCCTG

GCAGAACTCTGTGTCTGAGCGGCCACCCTACTCTTACATGGCCATGATA

CAATTCGCCATCAACAGCACTGAGAGGAAGCGCATGACTTTGAAAGACA

TCTATACGTGGATTGAGGACCACTTTCCCTACTTTAAGCACATTGCCAA

GCCAGGCTGGAAGAACTCCATCCGCCACAACCTTTCCCTGCACGACATG

TTTGTCCGGGAGACGTCTGCCAATGGCAAGGTCTCCTTCTGGACCATTC

ACCCCAGTGCCAACCGCTACTTGACATTGGACCAGGTGTTTAAGCCACT

GGACCCAGGGTCTCCACAATTGCCCGAGCACTTGGAATCACAGCAGAAA

CGACCGAATCCAGAGCTCCGCCGGAACATGACCATCAAAACCGAACTCC

CCCTGGGCGCACGGCGGAAGATGAAGCCACTGCTACCACGGGTCAGCTC

ATACCTGGTACCTATCCAGTTCCCGGTGAACCAGTCACTGGTGTTGCAG

CCCTCGGTGAAGGTGCCATTGCCCCTGGCGGCTTCCCTCATGAGCTCAG

AGCTTGCCCGCCATAGCAAGCGAGTCCGCATTGCCCCCAAGGTGCTGCT

AGCTGAGGAGGGGATAGCTCCTCTTTCTTCTGCAGGACCAGGGAAAGAG

GAGAAACTCCTGTTTGGAGAAGGGTTTTCTCCTTTGCTTCCAGTTCAGA

CTATCAAGGAGGAAGAAATCCAGCCTGGGGAGGAAATGCCACACTTAGC

GAGACCCATCAAAGTGGAGAGCCCTCCCTTGGAAGAGTGGCCCTCCCCG

GCCCCATCTTTCAAAGAGGAATCATCTCACTCCTGGGAGGATTCGTCCC

AATCTCCCACCCCAAGACCCAAGAAGTCCTACAGTGGGCTTAGGTCCCC

AACCCGGTGTGTCTCGGAAATGCTTGTGATTCAACACAGGGAGAGGAGG

GAGAGGAGCCGGTCTCGGAGGAAACAGCATCTACTGCCTCCCTGTGTGG

ATGAGCCGGAGCTGCTCTTCTCAGAGGGGCCCAGTACTTCCCGCTGGGC

CGCAGAGCTCCCGTTCCCAGCAGACTCCTCTGACCCTGCCTCCCAGCTC

AGCTACTCCCAGGAAGTGGGAGGACCTTTTAAGACACCCATTAAGGAAA

CGCTGCCCATCTCCTCCACCCCGAGCAAATCTGTCCTCCCCAGAACCCC

TGAATCCTGGAGGCTCACGCCCCCAGCCAAAGTAGGGGGACTGGATTTC

AGCCCAGTACAAACCTCCCAGGGTGCCTCTGACCCCTTGCCTGACCCCC

TGGGGCTGATGGATCTCAGCACCACTCCCTTGCAAAGTGCTCCCCCCCT

TGAATCACCGCAAAGGCTCCTCAGTTCAGAACCCTTAGACCTCATCTCC

GTCCCCTTTGGCAACTCTTCTCCCTCAGATATAGACGTCCCCAAGCCAG

GCTCCCCGGAGCCACAGGTTTCTGGCCTTGCAGCCAATCGTTCTCTGAC

-continued

AGAAGGCCTGGTCCTGGACACAATGAATGACAGCCTCAGCAAGATCCTG

CTGGACATCAGCTTTCCTGGCCTGGACGAGGACCCACTGGGCCCTGACA

ACATCAACTGGTCCCAGTTTATTCCTGAGCTACAG, or a nucleic acid sequence that hybridizes to a nucleic acid sequence consisting of SEQ ID NO:48 under stringent hybridization conditions.

In some embodiments, Forkhead box N1 (FOXN1) comprises the amino acid sequence:

(SEQ ID NO: 49; NP_003584)

MVSLPPPQSDVTLPGPTRLEGERQGDLMQAPGLPGSPAPQSKHAGFSCS

SFVSDGPPERTPSLPPHSPRIASPGPEQVQGHCPAGPGPGPFRLSPSDK

YPGFGFEEAAASSPGRFLKGSHAPFHPYKRPFHEDVFPEAETTLALKGH

SFKTPGPLEAFEEIPVDVAEAEAFLPGFSAEAWCNGLPYPSQEHGPQVL

GSEVKVKPPVLESGAGMFCYQPPLQHMYCSSQPPFHQYSPGGGSYPIPY

LGSSHYQYQRMAPQASTDGHQPLFPKPIYSYSILIFMALKNSKTGSLPV

SEIYNFMTEHFPYFKTAPDGWKNSVRHNLSLNKCFEKVENKSGSSSRKG

CLWALNPAKIDKMQEELQKWKRKDPIAVRKSMAKPEELDSLIGDKREKL

GSPLLGCPPPGLSGSGPIRPLAPPAGLSPPLHSLHPAPGPIPGKNPLQD

LLMGHTPSCYGQTYLHLSPGLAPPGPPQPLFPQPDGHLELRAQPGTPQD

SPLPAHTPPSHSAKLLAEPSPARTMHDTLLPDGDLGTDLDAINPSLTDF

DFQGNLWEQLKDDSLALDPLVLVTSSPTSSSMPPPQPPPHCFPPGPCLT

ETGSGAGDLAAPGSGGSGALGDLHLTTLYSAFMELEPTPPTAPAGPSVY

LSPSSKPVALA, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:49.

In some embodiments, the nucleic acid sequence encoding FOXN1 comprises the nucleic acid sequence:

(SEQ ID NO: 50; NM_003593)

ATGGTGTCGCTACCCCCGCCGCAGTCTGACGTCACGCTGCCGGGCCCCA

CCAGACTGGAGGGCGAGCGCCAAGGGGACCTCATGCAGGCACCGGGCCT

CCCAGGCTCCCCTGCCCCACAGAGTAAGCATGCCGGCTTCAGCTGCTCG

TCATTTGTGTCCGACGGCCCTCCAGAGAGGACACCCTCACTGCCCCCAC

ACAGCCCCCGCATTGCGTCACCAGGGCCCGAGCAAGTCCAGGGCCACTG

CCCAGCCGGCCCCGGCCCTGGGCCCTTCAGGCTCTCACCCTCAGACAAG

TATCCTGGCTTTGGCTTTGAGGAGGCCGCAGCAAGCAGCCCTGGGCGAT

TCCTCAAGGGCAGCCACGCGCCCTTCCACCCGTACAAGCGGCCTTTCCA

TGAGGACGTCTTCCCAGAGGCCGAGACCACCCTGGCCCTCAAAGGACAC

TCCTTTAAGACCCCAGGGCCGCTGGAGGCCTTCGAGGAGATCCCAGTGG

ACGTGGCGGAGGCCGAGGCCTTCCTGCCTGGCTTCTCAGCAGAGGCCTG

GTGTAACGGGCTCCCCTACCCCAGCCAGGAGCATGGCCCCCAAGTCCTG

GGTTCAGAGGTCAAAGTCAAGCCCCCAGTTCTGGAGAGTGGTGCTGGGA

-continued

TGTTCTGCTACCAGCCTCCCTTGCAGCATATGTACTGCTCCTCCCAGCC

CCCCTTCCACCAGTACTCGCCAGGTGGTGGCAGCTACCCCATACCCTAC

CTGGGCTCCTCACACTATCAGTACCAGCGAATGGCACCCCAGGCCAGCA

CCGATGGGCACCAGCCTCTCTTCCCAAAACCCATCTATTCCTACAGCAT

CCTCATCTTCATGGCCCTTAAGAACAGTAAAACTGGGAGCCTTCCCGTC

AGCGAGATCTACAATTTTATGACGGAGCACTTTCCTTACTTCAAGACAG

CACCCGATGGCTGGAAGAATTCTGTCCGGCACAACCTATCCCTCAACAA

GTGCTTCGAGAAGGTGGAGAACAAATCAGGAAGTTCCTCCCGCAAGGGC

TGCCTGTGGGCCCTCAATCCGGCCAAGATCGACAAGATGCAAGAGGAGC

TGCAAAAATGGAAGAGGAAAGATCCCATTGCTGTGCGCAAAAGCATGGC

CAAGCCAGAAGAGCTGGACAGCCTCATTGGAGACAAGAGAGAAAAGCTG

GGCTCCCCACTCCTGGGCTGTCCGCCCCCTGGGCTGTCCGGCTCAGGCC

CCATCCGGCCCCTGGCACCCCCAGCTGGCCTCTCCCCACCACTGCACTC

ACTCCACCCAGCTCCAGGCCCCATTCCTGGCAAGAACCCCCTGCAGGAC

CTACTTATGGGGCACACACCCTCCTGCTATGGGCAGACATACTTGCACC

TCTCACCAGGCCTGGCCCCTCCTGGACCCCCGCAGCCATTGTTCCCACA

GCCGGACGGGCACCTTGAGCTGCGGGCCCAGCCAGGCACCCCCCAGGAC

TCGCCTCTGCCTGCCCACACCCCACCCAGCCACAGTGCCAAGCTACTGG

CCGAGCCTTCCCCAGCCAGGACTATGCACGACACCCTGCTGCCAGATGG

AGACCTTGGCACTGACCTGGATGCCATCAATCCCTCACTCACTGACTTC

GACTTCCAGGGAAACCTGTGGGAACAGTTGAAGGATGATAGCTTGGCCC

TCGACCCCCTGGTACTGGTGACCTCATCCCCGACATCATCTTCGATGCC

ACCACCCCAGCCACCACCTCACTGCTTCCCCCCTGGGCCCTGTCTGACA

GAGACAGGCAGTGGGGCAGGTGACTTGGCAGCCCCGGGCAGTGGTGGCT

CCGGGGCACTGGGTGACCTGCACCTCACCACCCTCTACTCTGCCTTTAT

GGAGCTGGAGCCACGCCCCCCACGGCCCCTGCAGGCCCCTCTGTGTACC

TCAGCCCCAGCTCCAAGCCCGTGGCCCTGGCA, or a nucleic acid sequence that hybridizes to a nucleic acid sequence consisting of SEQ ID NO:50 under stringent hybridization conditions.

In some embodiments, Forhead box N2 (FOXN2) comprises the amino acid sequence:

(SEQ ID NO: 51; NP_002149)

MGPVIGMTPDKRAETPGAEKIAGLSQIYKMGSLPEAVDAARPKATLVDS

ESADDELTNLNWLHESTNLLTNFSLGSEGLPIVSPLYDIEGDDVPSFGP

ACYQNPEKKSATSKPPYSFSLLIYMAIEHSPNKCLPVKEIYSWILDHFP

YFATAPTGWKNSVRHNLSLNKCFQKVERSHGKVNGKGSLWCVDPEYKPN

LIQALKKQPFSSASSQNGSLSPHYLSSVIKQNQVRNLKESDIDAAAAMM

LLNTSIEQGILECEKPLPLKTALQKKRSYGNAFHHPSAVRLQESDSLAT

-continued

SIDPKEDHNYSASSMAAQRCASRSSVSSLSSVDEVYEFIPKNSHVGSDG

SEGFHSEEDTDVDYEDDPLGDSGYASQPCAKISEKGQSGKKMRKQTCQE

IDEELKEAAGSLLHLAGIRTCLGSLISTAKTQNQKQRKK, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:51.

In some embodiments, the nucleic acid sequence encoding FOXN2 comprises the nucleic acid sequence:

(SEQ ID NO: 52; NM_002158)

ATGGGTCCAGTAATTGGAATGACTCCAGATAAGAGAGCTGAAACCCCAG

GAGCTGAAAAGATTGCAGGATTAAGCCAGATTTACAAAATGGGAAGCTT

GCCTGAAGCTGTTGATGCTGCCAGGCCGAAGGCCACTCTAGTGGACAGT

GAGTCAGCAGATGATGAACTCACAAACTTGAACTGGCTTCATGAAAGCA

CTAATCTTCTAACAAACTTCAGCCTCGGAAGTGAGGGTCTTCCAATTGT

TAGTCCATTGTATGACATAGAGGGAGATGATGTGCCATCCTTTGGACCA

GCTTGCTACCAGAACCCAGAAAAAAAATCAGCGACTTCAAAGCCCCCAT

ACTCCTTTAGTCTTCTCATTTATATGGCCATTGAGCACTCTCCAAATAA

ATGTTTGCCTGTCAAAGAAATTTATAGCTGGATTCTGGACCATTTTCCA

TATTTTGCTACTGCACCAACAGGCTGGAAGAATTCTGTTCGACATAATC

TGTCCCTGAATAAATGTTTTCAGAAAGTGGAAAGAAGCCATGGCAAGGT

TAATGGAAAAGGTTCCTTATGGTGTGTTGATCCGGAATATAAACCCAAT

CTTATCCAGGCACTGAAGAAGCAACCTTTTTCTTCAGCATCTTCACAAA

ATGGTTCTTTATCACCTCACTATTTAAGCTCTGTAATCAAGCAGAACCA

GGTGCGAAACCTCAAAGAATCTGATATTGATGCTGCTGCTGCAATGATG

CTTTTAAATACTTCTATAGAACAAGGAATTTTAGAATGTGAGAAGCCTC

TTCCTCTTAAAACAGCATTGCAAAAAAAGAGGAGTTACGGCAATGCATT

TCATCATCCCAGTGCTGTACGATTACAAGAGAGTGATTCTTTAGCCACC

AGCATTGATCCAAAAGAAGATCACAATTACAGTGCAAGTAGCATGGCAG

CACAGCGTTGTGCATCCAGGTCTAGCGTGTCTTCTCTGTCTTCTGTGGA

TGAGGTATATGAATTTATCCCAAAGAATAGTCACGTGGGAAGTGATGGC

AGTGAAGGATTTCACAGTGAAGAAGATACAGACGTTGATTATGAAGATG

ATCCTCTTGGAGACAGTGGCTATGCATCACAGCCTTGTGCAAAAATCTC

TGAAAAAGGGCAGTCAGGCAAAAAGATGCGAAAACAGACATGTCAAGAA

ATTGATGAGGAGCTCAAAGAGGCAGCTGGATCTCTGCTCCACCTTGCTG

GAATTCGTACATGTTTAGGTTCCCTAATAAGTACTGCAAAGACACAAAA

TCAAAAGCAACGGAAAAAA, or a nucleic acid sequence that hybridizes to a nucleic acid sequence consisting of SEQ ID NO:52 under stringent hybridization conditions.

In some embodiments, Forkhead box N3 (FOXN3) comprises the amino acid sequence:

(SEQ ID NO: 53; NP_001078940)

MGPVMPPSKKPESSGISVSSGLSQCYGGSGFSKALQEDDDLDFSLPDIR

LEEGAMEDEELTNLNWLHESKNLLKSFGESVLRSVSPVQDLDDDTPPSP

AHSDMPYDARQNPNCKPPYSFSCLIFMAIEDSPTKRLPVKDIYNWILEH

FPYFANAPTGWKNSVRHNLSLNKCFKKVDKERSQSIGKGSLWCIDPEYR

QNLIQALKKTPYHPHPHVFNTPPTCPQAYQSTSGPPIWPGSTFFKRNGA

LLQDPDIDAASAMMLLNTPPEIQAGFPPGVIQNGARVLSRGLFPGVRPL

PITPIGVTAAMRNGITSCRMRTESEPSCGSPVVSGDPKEDHNYSSAKSS

NARSTSPTSDSISSSSSSADDHYEFATKGSQEGSEGSEGSFRSHESPSD

TEEDDRKHSQKEPKDSLGDSGYASQHKKRQHFAKARKVPSDTLPLKKRR

TEKPPESDDEEMKEAAGSLLHLAGIRSCLNNITNRTAKGQKEQKETTK

N, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:53.

In some embodiments, the nucleic acid sequence encoding FOXN3 comprises the nucleic acid sequence:

(SEQ ID NO: 54; NM_001085471)

ATGGGTCCAGTCATGCCTCCCAGTAAGAAGCCAGAAAGCTCAGGAATTA

GTGTCTCCAGTGGACTGAGTCAGTGTTACGGGGGCAGCGGTTTCTCCAA

GGCCCTTCAGGAAGACGATGACCTCGACTTTTCTCTGCCTGACATCCGA

TTAGAAGAGGGGGCCATGGAAGATGAAGAGCTGACCAACCTGAACTGGC

TGCACGAGAGCAAGAACTTGCTGAAGAGCTTTGGGGAGTCGGTCCTCAG

GAGTGTCAGCCCCGTCCAGGACCTGGACGATGACACCCCCCCATCCCCT

GCCCACTCTGACATGCCCTACGATGCCAGGCAGAACCCCAACTGCAAAC

CCCCCTACTCCTTCAGCTGCCTCATATTTATGGCCATCGAGGACTCTCC

AACCAAGCGCCTGCCAGTGAAGGATATCTACAACTGGATCTTGGAACAT

TTTCCGTATTTTGCAAATGCACCTACTGGGTGGAAAAACTCAGTGAGAC

ACAATTTATCATTGAATAAGTGTTTTAAGAAAGTGGACAAAGAGAGGAG

TCAGAGTATTGGGAAAGGGTCGTTGTGGTGCATAGACCCAGAGTATAGA

CAAAATCTAATTCAGGCTTTGAAAAAGACACCTTATCACCCACACCCAC

ACGTGTTCAATACACCTCCCACCTGTCCTCAGGCATATCAAAGCACATC

AGGTCCACCCATCTGGCCGGGCAGTACCTTCTTCAAGAGAAATGGAGCC

CTTCTCCAAGATCCTGACATTGATGCTGCCAGTGCCATGATGCTTTTGA

ATACTCCCCCTGAGATACAAGCAGGTTTTCCTCCAGGAGTGATCCAAAA

TGGAGCGCGGGTCCTGAGCCGAGGGCTGTTTCCTGGCGTGCGGCCGCTG

CCAATCACTCCCATTGGGGTGACAGCGGCCATGAGGAATGGCATCACCA

GCTGCCGGATGCGGACTGAGAGTGAGCCATCTTGTGGCTCCCCAGTGGT

CAGCGGAGACCCCAAGGAGGATCACAACTACAGCAGTGCCAAGTCCTCC

-continued

AACGCCCGGAGCACCTCGCCCACCAGCGACTCCATCTCCTCCTCCTCCT

CCTCAGCCGACGACCACTATGAGTTTGCCACCAAGGGGAGCCAGGAGGG

CAGCGAGGGCAGCGAGGGGAGCTTCCGGAGCCACGAGAGCCCCAGCGAC

ACGGAAGAGGACGACAGGAAGCACAGCCAGAAGGAGCCCAAGGATTCTC

TGGGGGACAGCGGGTACGCATCCCAGCACAAGAAGCGCCAGCACTTCGC

CAAGGCCAGGAAGGTCCCCAGCGACACACTGCCCCTCAAAAAGAGACGC

ACCGAAAAGCCCCCCGAGAGCGATGATGAGGAGATGAAAGAAGCGGCAG

GGTCCCTCCTGCACTTAGCAGGGATCCGGTCCTGTTTGAATAACATCAC

CAATCGGACGGCAAAGGGGCAGAAAGAGCAAAAGGAAACCACAAAAAA

T, or a nucleic acid sequence that hybridizes to a nucleic acid sequence consisting of SEQ ID NO:54 under stringent hybridization conditions.

In some embodiments, Forkhead box N4 (FOXN4) comprises the amino acid sequence:

(SEQ ID NO: 55; NP_998761)

MIESDTSSIMSGIIRNSGQNHHPSPQEYRLLATTSDDDLPGDLQSLSWL

TAVDVPRLQQMASGRVDLGGPCVPHPHPGALAGVADLHVGATPSPLLHG

PAGMAPRGMPGLGPITGHRDSMSQFPVGGQPSSGLQDPPHLYSPATQPQ

FPLPPGAQQCPPVGLYGPPFGVRPPYPQPHVAVHSSQELHPKHYPKPIY

SYSCLIAMALKNSKTGSLPVSEIYSFMKEHFPYFKTAPDGWKNSVRHNL

SLNKCFEKVENKMSGSSRKGCLWALNLARIDKMEEEMHKWKRKDLAAIH

RSMANPEELDKLISDRPESCRRPGKPGEPEAPVLTHATTVAVAHGCLAV

SQLPPQPLMTLSLQSVPLHHQVQPQAHLAPDSPAPAQTPPLHALPDLSP

SPLPHPAMGRAPVDFINISTDMNTEVDALDPSIMDFALQGNLWEEMKDE

GFSLDTLGAFADSPLGCDLGASGLTPASGGSDQSFPDLQVTGLYTAYST

PDSVAASGTSSSSQYLGAQGNKPIALL, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:55.

In some embodiments, the nucleic acid sequence encoding FOXN4 comprises the nucleic acid sequence:

(SEQ ID NO: 56; NM_213596)

ATGATAGAAAGTGACACCTCATCCATAATGTCAGGAATTATTCGAAACT

CAGGGCAAAATCACCACCCCTCTCCACAGGAATACAGGCTTCTAGCCAC

CACCAGCGATGATGACCTTCCCGGGGACCTGCAGTCGCTGTCGTGGCTC

ACGGCGGTGGATGTGCCTCGGCTGCAGCAGATGGCAAGTGGCCGCGTGG

ACCTGGGTGGCCCCTGCGTGCCACATCCACACCCAGGTGCCTTGGCTGG

GGTGGCCGACCTGCATGTGGGAGCCACTCCAAGTCCCCTTCTCCATGGC

CCAGCAGGCATGGCCCCCCGAGGCATGCCAGGTCTGGGCCCCATAACTG

GCCACAGAGACAGCATGAGCCAGTTCCCCGTGGGGGGCCAGCCCTCATC

TGGCCTGCAGGACCCGCCGCATCTGTACTCACCTGCCACCCAACCACAG

-continued

TTCCCGCTCCCCCCGGGTGCCCAGCAGTGCCCTCCTGTGGGCCTCTATG

GCCCCCCATTTGGGGTGCGGCCCCCCTACCCCCAGCCCCACGTGGCTGT

GCATTCATCTCAAGAACTGCACCCCAAACACTACCCCAAGCCCATCTAC

TCGTACAGCTGTCTGATCGCCATGGCCCTGAAGAACAGCAAGACAGGCA

GCCTGCCTGTGAGCGAGATCTACAGCTTCATGAAGGAGCACTTCCCCTA

CTTCAAGACGGCCCCCGACGGGTGGAAGAACTCGGTGCGGCACAACCTG

TCTCTGAACAAGTGCTTCGAGAAGGTGGAGAACAAGATGAGCGGCTCCT

CCCGCAAGGGCTGCCTGTGGGCTCTGAACCTGGCCCGCATCGACAAGAT

GGAGGAGGAGATGCACAAGTGGAAGAGGAAGGACCTGGCTGCCATCCAC

CGGAGTATGGCCAACCCTGAGGAGTTGGACAAGCTGATCTCCGACCGGC

CTGAAAGCTGCCGGCGCCCCGGCAAACCGGGGGAACCAGAGGCCCCCGT

GCTGACTCACGCCACCACAGTGGCCGTGGCGCATGGCTGCCTGGCTGTC

TCCCAGCTCCCACCCCAGCCACTGATGACCCTGTCCCTGCAGTCAGTCC

CCCTGCACCACCAGGTCCAGCCCCAGGCACATCTTGCTCCAGACTCTCC

AGCACCAGCCCAGACCCCGCCACTGCACGCCCTGCCGGACCTCAGCCCC

AGCCCGCTCCCCCACCCCGCCATGGGAAGGGCTCCTGTAGACTTCATCA

ACATCAGCACCGACATGAACACTGAGGTGGATGCCCTCGACCCGAGCAT

CATGGACTTCGCTCTGCAGGGGAACCTGTGGGAGGAGATGAAGGATGAG

GGATTCAGCTTGGACACACTGGGCGCCTTTGCAGACTCCCCGCTTGGCT

GTGACCTGGGGGCCTCAGGCCTAACCCCTGCCTCGGGTGGCAGCGACCA

GTCCTTCCCAGACTTGCAGGTGACGGGTCTCTACACAGCGTACTCCACT

CCGGACAGTGTGGCTGCATCGGGCACCAGCTCCTCCTCCCAGTACCTGG

GTGCACAGGGGAACAAGCCTATAGCCCTGCTT, or a nucleic acid sequence that hybridizes to a nucleic acid sequence consisting of SEQ ID NO:56 under stringent hybridization conditions.

In some embodiments, Forkhead Box 01 (FOXO1) comprises the amino acid sequence:

(SEQ ID NO: 57; NP_002006)

MAEAPQVVEIDPDFEPLPRPRSCTWPLPRPEFSQSNSATSSPAPSGSAA

ANPDAAAGLPSASAAAVSADFMSNLSLLEESEDFPQAPGSVAAAVAAAA

AAAATGGLCGDFQGPEAGCLHPAPPQPPPPGPLSQHPPVPPAAAGPLAG

QPRKSSSSRRNAWGNLSYADLITKAIESSAEKRLTLSQIYEWMVKSVPY

FKDKGDSNSSAGWKNSIRHNLSLHSKFIRVQNEGTGKSSWWMLNPEGGK

SGKSPRRRAASMDNNSKFAKSRSRAAKKKASLQSGQEGAGDSPGSQFSK

WPASPGSHSNDDFDNWSTFRPRTSSNASTISGRLSPIMTEQDDLGEGDV

HSMVYPPSAAKMASTLPSLSEISNPENMENLLDNLNLLSSPTSLTVSTQ

SSPGTMMQQTPCYSFAPPNTSLNSPSPNYQKYTYGQSSMSPLPQMPIQT

LQDNKSSYGGMSQYNCAPGLLKELLTSDSPPHNDIMTPVDPGVAQPNSR

VLGQNVMMGPNSVMSTYGSQVSHNKMMNPSSHTHPGHAQQTSAVNGRPL

PHTVSTMPHTSGMNRLTQVKTPVQVPLPHPMQMSALGGYSSVSSCNGYG

-continued

RMGLLHQEKLPSDLDGMFIERLDCDMESIIRNDLMDGDTLDFNFDNVLP

NQSFPHSVKTTTHSWVSG, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:57.

In some embodiments, the nucleic acid sequence encoding FOXO1 comprises the nucleic acid sequence:

(SEQ ID NO: 58; NM_002015)

ATGGCCGAGGCGCCTCAGGTGGTGGAGATCGACCCGGACTTCGAGCCGC

TGCCCCGGCCGCGCTCGTGCACCTGGCCGCTGCCCAGGCCGGAGTTTAG

CCAGTCCAACTCGGCCACCTCCAGCCCGGCGCCGTCGGGCAGCGCGGCT

GCCAACCCCGACGCCGCGGCGGGCCTGCCCTCGGCCTCGGCTGCCGCTG

TCAGCGCCGACTTCATGAGCAACCTGAGCTTGCTGGAGGAGAGCGAGGA

CTTCCCGCAGGCGCCCGGCTCCGTGGCGGCGGCGGTGGCGGCGGCGGCC

GCCGCGGCCGCCACCGGGGGGCTGTGCGGGGACTTCCAGGGCCCGGAGG

CGGGCTGCCTGCACCCAGCGCCACCGCAGCCCCCGCCGCCCGGGCCGCT

GTCGCAGCACCCGCCGGTGCCCCCCGCCGCCGCTGGGCCGCTCGCGGGG

CAGCCGCGCAAGAGCAGCTCGTCCCGCCGCAACGCGTGGGGCAACCTGT

CCTACGCCGACCTCATCACCAAGGCCATCGAGAGCTCGGCGGAGAAGCG

GCTCACGCTGTCGCAGATCTACGAGTGGATGGTCAAGAGCGTGCCCTAC

TTCAAGGATAAGGGTGACAGCAACAGCTCGGCGGGCTGGAAGAATTCAA

TTCGTCATAATCTGTCCCTACACAGCAAGTTCATTCGTGTGCAGAATGA

AGGAACTGGAAAAAGTTCTTGGTGGATGCTCAATCCAGAGGGTGGCAAG

AGCGGGAAATCTCCTAGGAGAAGAGCTGCATCCATGGACAACAACAGTA

AATTTGCTAAGAGCCGAAGCCGAGCTGCCAAGAAGAAAGCATCTCTCCA

GTCTGGCCAGGAGGGTGCTGGGGACAGCCCTGGATCACAGTTTTCCAAA

TGGCCTGCAAGCCCTGGCTCTCACAGCAATGATGACTTTGATAACTGGA

GTACATTTCGCCCTCGAACTAGCTCAAATGCTAGTACTATTAGTGGGAG

ACTCTCACCCATTATGACCGAACAGGATGATCTTGGAGAAGGGGATGTG

CATTCTATGGTGTACCCGCCATCTGCCGCAAAGATGGCCTCTACTTTAC

CCAGTCTGTCTGAGATAAGCAATCCCGAAAACATGGAAAATCTTTTGGA

TAATCTCAACCTTCTCTCATCACCAACATCATTAACTGTTTCGACCCAG

TCCTCACCTGGCACCATGATGCAGCAGACGCCGTGCTACTCGTTTGCGC

CACCAAACACCAGTTTGAATTCACCCAGCCCAAACTACCAAAAATATAC

ATATGGCCAATCCAGCATGAGCCCTTTGCCCCAGATGCCTATACAAACA

CTTCAGGACAATAAGTCGAGTTATGGAGGTATGAGTCAGTATAACTGTG

CGCCTGGACTCTTGAAGGAGTTGCTGACTTCTGACTCTCCTCCCCATAA

TGACATTATGACACCAGTTGATCCTGGGGTAGCCCAGCCCAACAGCCGG

GTTCTGGGCCAGAACGTCATGATGGGCCCTAATTCGGTCATGTCAACCT

ATGGCAGCCAGGTATCTCATAACAAAATGATGAATCCCAGCTCCCATAC

CCACCCTGGACATGCTCAGCAGACATCTGCAGTTAACGGGCGTCCCCTG

-continued

```
CCCCACACGGTAAGCACCATGCCCCACACCTCGGGTATGAACCGCCTGA
CCCAAGTGAAGACACCTGTACAAGTGCCTCTGCCCCACCCCATGCAGAT
GAGTGCCCTGGGGGGCTACTCCTCCGTGAGCAGCTGCAATGGCTATGGC
AGAATGGGCCTTCTCCACCAGGAGAAGCTCCCAAGTGACTTGGATGGCA
TGTTCATTGAGCGCTTAGACTGTGACATGGAATCCATCATTCGGAATGA
CCTCATGGATGGAGATACATTGGATTTTAACTTTGACAATGTGTTGCCC
AACCAAAGCTTCCCACACAGTGTCAAGACAACGACACATAGCTGGGTGT
CAGGC,
```

or a nucleic acid sequence that hybridizes to a nucleic acid sequence consisting of SEQ ID NO:58 under stringent hybridization conditions.

In some embodiments, Forkhead Box 03 (FOXO3) comprises the amino acid sequence:

```
                                    (SEQ ID NO: 59; NP_001446)
MAEAPASPAPLSPLEVELDPEFEPQSRPRSCTWPLQRPELQASPAKPSG
ETAADSMIPEEEDDEDDEDGGGRAGSAMAIGGGGGSGTLGSGLLLEDSA
RVLAPGGQDPGSGPATAAGGLSGGTQALLQPQQPLPPPQPGAAGGSGQP
RKCSSRRNAWGNLSYADLITRAIESSPDKRLTLSQIYEWMVRCVPYFKD
KGDSNSSAGWKNSIRHNLSLHSRFMRVQNEGTGKSSWWIINPDGGKSGK
APRRRAVSMDNSNKYTKSRGRAAKKKAALQTAPESADDSPSQLSKWPGS
PTSRSSDELDAWTDFRSRTNSNASTVSGRLSPIMASTELDEVQDDDAPL
SPMLYSSSASLSPSVSKPCTVELPRLTDMAGTMNLNDGLTENLMDDLLD
NITLPPSQPSPTGGLMQRSSSFPYTTKGSGLGSPTSSFNSTVFGPSSLN
SLRQSPMQTIQENKPATFSSMSHYGNQTLQDLLTSDSLSHSDVMMTQSD
PLMSQASTAVSAQNSRRNVMLRNDPMMSFAAQPNQGSLVNQNLLHHQHQ
TQGALGGSRALSNSVSNMGLSESSSLGSAKHQQQSPVSQSMQTLSDSLS
GSSLYSTSANLPVMGHEKFPSDLDLDMFNGSLECDMESIIRSELMDADG
LDFNFDSLISTQNVVGLNVGNFTGAKQASSQSWVPG,
```

or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:59.

In some embodiments, the nucleic acid sequence encoding FOXO3 comprises the nucleic acid sequence:

```
                                    (SEQ ID NO: 60; NM_001455)
ATGGCAGAGGCACCGGCTTCCCCGGCCCCGCTCTCTCCGCTCGAAGTGG
AGCTGGACCCGGAGTTCGAGCCCCAGAGCCGTCCGCGATCCTGTACGTG
GCCCCTGCAAAGGCCGGAGCTCCAAGCGAGCCCTGCCAAGCCCTCGGGG
GAGACGGCCGCTGACTCCATGATCCCCGAGGAGGAGGACGATGAAGACG
ACGAGGACGGCGGGGGACGGGCCGGCTCGGCCATGGCGATCGGCGGCGG
CGGCGGGAGCGGCACGCTGGGCTCCGGGCTGCTCCTTGAGGACTCGGCC
CGGGTGCTGGCACCCGGAGGGCAAGACCCCGGGTCTGGGCCAGCCACCG
```

-continued

```
CGGCGGGCGGGCTGAGCGGGGGTACACAGGCGCTGCTGCAGCCTCAGCA
ACCGCTGCCACCGCCGCAGCCGGGGGCGGCTGGGGGCTCCGGGCAGCCG
AGGAAATGTTCGTCGCGGCGGAACGCCTGGGGAAACCTGTCCTACGCGG
ACCTGATCACCCGCGCCATCGAGAGCTCCCCGGACAAACGGCTCACTCT
GTCCCAGATCTACGAGTGGATGGTGCGTTGCGTGCCCTACTTCAAGGAT
AAGGGCGACAGCAACAGCTCTGCCGGCTGGAAGAACTCCATCCGGCACA
ACCTGTCACTGCATAGTCGATTCATGCGGGTCCAGAATGAGGGAACTGG
CAAGAGCTCTTGGTGGATCATCAACCCTGATGGGGGGAAGAGCGGAAAA
GCCCCCCGGCGGCGGGCTGTCTCCATGGACAATAGCAACAAGTATACCA
AGAGCCGTGGCCGCGCAGCCAAGAAGAAGGCAGCCCTGCAGACAGCCCC
CGAATCAGCTGACGACAGTCCCTCCCAGCTCTCCAAGTGGCCTGGCAGC
CCCACGTCACGCAGCAGTGATGAGCTGGATGCGTGGACGGACTTCCGTT
CACGCACCAATTCTAACGCCAGCACAGTCAGTGGCCGCCTGTCGCCCAT
CATGGCAAGCACAGAGTTGGATGAAGTCCAGGACGATGATGCGCCTCTC
TCGCCCATGCTCTACAGCAGCTCAGCCAGCCTGTCACCTTCAGTAAGCA
AGCCGTGCACGGTGGAACTGCCACGGCTGACTGATATGGCAGGCACCAT
GAATCTGAATGATGGGCTGACTGAAAACCTCATGGACGACCTGCTGGAT
AACATCACGCTCCCGCCATCCCAGCCATCGCCCACTGGGGGACTCATGC
AGCGGAGCTCTAGCTTCCCGTATACCACCAAGGGCTCGGGCCTGGGCTC
CCCAACCAGCTCCTTTAACAGCACGGTGTTCGGACCTTCATCTCTGAAC
TCCCTACGCCAGTCTCCCATGCAGACCATCCAAGAGAACAAGCCAGCTA
CCTTCTCTTCCATGTCACACTATGGTAACCAGACACTCCAGGACCTGCT
CACTTCGGACTCACTTAGCCACAGCGATGTCATGATGACACAGTCGGAC
CCCTTGATGTCTCAGGCCAGCACCGCTGTGTCTGCCCAGAATTCCCGCC
GGAACGTGATGCTTCGCAATGATCCGATGATGTCCTTTGCTGCCCAGCC
TAACCAGGGAAGTTTGGTCAATCAGAACTTGCTCCACCACCAGCACCAA
ACCCAGGGCGCTCTTGGTGGCAGCCGTGCCTTGTCGAATTCTGTCAGCA
ACATGGGCTTGAGTGAGTCCAGCAGCCTTGGGTCAGCCAAACACCAGCA
GCAGTCTCCTGTCAGCCAGTCTATGCAAACCCTCTCGGACTCTCTCTCA
GGCTCCTCCTTGTACTCAACTAGTGCAAACCTGCCCGTCATGGGCCATG
AGAAGTTCCCCAGCGACTTGGACCTGGACATGTTCAATGGGAGCTTGGA
ATGTGACATGGAGTCCATTATCCGTAGTGAACTCATGGATGCTGATGGG
TTGGATTTTAACTTTGATTCCCTCATCTCCACACAGAATGTTGTTGGTT
TGAACGTGGGGAACTTCACTGGTGCTAAGCAGGCCTCATCTCAGAGCTG
GGTGCCAGGC,
```

or a nucleic acid sequence that hybridizes to a nucleic acid sequence consisting of SEQ ID NO:60 under stringent hybridization conditions.

In some embodiments, Forkhead Box 04 (FOXO4) comprises the amino acid sequence:

(SEQ ID NO: 61; NP_005929)
MDPGNENSATEAAAIIDLDPDFEPQSRPRSCTWPLPRPEIANQPSEPPE
VEPDLGEKVHTEGRSEPILLPSRLPEPAGGPQPGILGAVTGPRKGGSRR
NAWGNQSYAELISQAIESAPEKRLTLAQIYEWMVRTVPYFKDKGDSNSS
AGWKNSIRHNLSLHSKFIKVHNEATGKSSWWMLNPEGGKSGKAPRRRAA
SMDSSSKLLRGRSKAPKKKPSVLPAPPEGATPTSPVGHFAKWSGSPCSR
NREEADMWTTFRPRSSSNASSVSTRLSPLRPESEVLAEEIPASVSSYAG
GVPPTLNEGLELLDGLNLTSSHSLLSRSGLSGFSLQHPGVTGPLHTYSS
SLFSPAEGPLSAGEGCFSSSQALEALLTSDTPPPPADVLMTQVDPILSQ
APTLLLLGGLPSSSKLATGVGLCPKPLEAPGPSSLVPTLSMIAPPPVMA
SAPIPKALGTPVLTPPTEAASQDRMPQDLDLDMYMENLECDMDNIISDL
MDEGEGLDFNFEPDP, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:61.

In some embodiments, the nucleic acid sequence encoding FOXO4 comprises the nucleic acid sequence:

(SEQ ID NO: 62; NM_005938)
ATGGATCCGGGGAATGAGAATTCAGCCACAGAGGCTGCCGCGATCATAG
ACCTAGATCCCGACTTCGAACCCCAGAGCCGTCCCCGCTCCTGCACCTG
GCCCCTTCCCCGACCAGAGATCGCTAACCAGCCGTCCGAGCCGCCCGAG
GTGGAGCCAGATCTGGGGGAAAAGGTACACACGGAGGGGCGCTCAGAGC
CGATCCTGTTGCCCTCTCGGCTCCCAGAGCCGGCCGGGGGCCCCCAGCC
CGGAATCCTGGGGGCTGTAACAGGTCCTCGGAAGGGAGGCTCCCGCCGG
AATGCCTGGGGAAATCAGTCATATGCAGAACTCATCAGCCAGGCCATTG
AAAGCGCCCCGGAGAAGCGACTGACACTTGCCCAGATCTACGAGTGGAT
GGTCCGTACTGTACCCTACTTCAAGGACAAGGGTGACAGCAACAGCTCA
GCAGGATGGAAGAACTCGATCCGCCACAACCTGTCCCTGCACAGCAAGT
TCATCAAGGTTCACAACGAGGCCACCGGCAAAAGCTCTTGGTGGATGCT
GAACCCTGAGGGAGGCAAGAGCGGCAAAGCCCCCCGCCGCCGGGCCGCC
TCCATGGATAGCAGCAGCAAGCTGCTCCGGGGCCGCAGTAAAGCCCCCA
AGAAGAAACCATCTGTGCTGCCAGCTCCACCCGAAGGTGCCACTCCAAC
GAGCCCTGTCGGCCACTTTGCCAAGTGGTCAGGCAGCCCTTGCTCTCGA
AACCGTGAAGAAGCCGATATGTGGACCACCTTCCGTCCACGAAGCAGTT
CAAATGCCAGCAGTGTCAGCACCCGGCTGTCCCCCTTGAGGCCAGAGTC
TGAGGTGCTGGCGGAGGAAATACCAGCTTCAGTCAGCAGTTATGCAGGG
GGTGTCCCTCCCACCCTCAATGAAGGTCTAGAGCTGTTAGATGGGCTCA
ATCTCACCTCTTCCCATTCCCTGCTATCTCGGAGTGGTCTCTCTGGCTT
CTCTTTGCAGCATCCTGGGGTTACCGGCCCCTTACACACCTACAGCAGC

-continued
TCCCTTTTCAGCCCAGCAGAGGGGCCCCTGTCAGCAGGAGAAGGGTGCT
TCTCCAGCTCCCAGGCTCTGGAGGCCCTGCTCACCTCTGATACGCCACC
ACCCCCTGCTGACGTCCTCATGACCCAGGTAGATCCCATTCTGTCCCAG
GCTCCGACTCTTCTGTTGCTGGGGGGGCTTCCTTCCTCCAGTAAGCTGG
CCACGGGCGTCGGCCTGTGTCCCAAGCCCCTAGAGGCTCCAGGCCCCAG
CAGTCTGGTTCCCACCCTTTCTATGATAGCACCACCTCCAGTCATGGCA
AGTGCCCCCATCCCCAAGGCTCTGGGGACTCCTGTGCTCACACCCCCTA
CTGAAGCTGCAAGCCAAGACAGAATGCCTCAGGATCTAGATCTTGATAT
GTATATGGAGAACCTGGAGTGTGACATGGATAACATCATCAGTGACCTC
ATGGATGAGGGCGAGGGACTGGACTTCAACTTTGAGCCAGATCCC, or a nucleic acid sequence that hybridizes to a nucleic acid sequence consisting of SEQ ID NO:62 under stringent hybridization conditions.

In some embodiments, Forkhead Box 06 (FOXO6) comprises the amino acid sequence:

(SEQ ID NO: 63; NP_001278210)
MAAKLRAHQVDVDPDFAPQSRPRSCTWPLPQPDLAGDEDGALGAGVAEG
AEDCGPERRATAPAMAPAPPLGAEVGPLRKAKSSRRNAWGNLSYADLIT
KAIESAPDKRLTLSQIYDWMVRYVPYFKDKGDSNSSAGWKNSIRHNLSL
HTRFIRVQNEGTGKSSWWMLNPEGGKTGKTPRRRAVSMDNGAKFLRIKG
KASKKKQLQAPERSPDDSSPSAPAPGPVPAAAKWAASPASHASDDYEAW
ADFRGGGRPLLGEAAELEDDEALEALAPSSPLMYPSPASALSPALGSRC
PGELPRLAELGGPLGLHGGGGAGLPEGLLDGAQDAYGPRAAPRPGPVLG
APGELALAGAAAAYPGKGAAPYAPPAPSRSALAHPISLMTLPGEAGAAG
LAPPGHAAAFGGPPGGLLLDALPGPYAAAAAGPLGAAPDRFPADLDLDM
FSGSLECDVESIIILNDFMDSDEMDFNFDSALPPPPPGLAGAPPPNQSWV
PG or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:63.

In some embodiments, the nucleic acid sequence encoding FOXO6 comprises the nucleic acid sequence:

(SEQ ID NO: 64; NM_001291281)
ATGGCTGCGAAGCTGCGAGCGCATCAGGTGGACGTGGACCCGGACTTCG
CGCCGCAGAGCCGGCCGCGCTCGTGTACCTGGCCCCTGCCGCAGCCTGA
CTTGGCCGGCGACGAGGACGGAGCGCTGGGCGCAGGGGTGGCCGAGGGC
GCCGAGGACTGCGGGCCGGAGCGCCGGGCTACGGCCCCGGCGATGGCCC
CAGCGCCGCCCCTGGGCGCGGAGGTCGGACCGCTGCGGAAAGCGAAGAG
CTCTCGGCGGAACGCGTGGGGGAACCTGTCCTACGCCGACCTCATCACC
AAAGCCATCGAGAGCGCCCCGGACAAGCGGCTCACGCTCTCGCAGATCT
ACGACTGGATGGTCCGTTACGTGCCCTACTTCAAGGATAAAGGCGACAG
CAACAGCTCGGCCGGCTGGAAGAACTCCATCCGGCACAACCTGTCGCTG

-continued

CACACCCGTTTCATCCGCGTGCAGAACGAGGGCACCGGCAAGAGTTCGT

GGTGGATGCTGAACCCCGAGGGCGGAAAGACAGGGAAGACCCCGCGGCG

CAGGGCCGTGTCCATGGACAACGGGGCCAAGTTCCTGCGCATCAAGGGC

AAGGCGAGCAAGAAGAAGCAGCTGCAGGCGCCCGAGCGAAGCCCGGACG

ACAGCTCCCCGAGTGCGCCCGCCCCGGGGCCGGTGCCTGCCGCAGCCAA

GTGGGCCGCCAGCCCCGCCTCGCACGCCAGCGACGACTACGAGGCTTGG

GCCGACTTCCGCGGCGGCGGGAGACCCCTGCTCGGGGAGGCGGCCGAGC

TGGAGGACGACGAGGCCCTGGAGGCCCTGGCGCCATCATCGCCGCTCAT

GTACCCAAGCCCCGCCAGCGCGCTGTCGCCGGCGCTGGGCTCGCGCTGT

CCGGGTGAGCTGCCCCGCCTGGCCGAGCTGGGAGGCCCGCTGGGCCTGC

ACGGCGGCGGCGGCGCGGGGCTGCCCGAGGGCCTGCTGGACGGCGCGCA

GGACGCGTACGGGCCGCGGGCCGCGCCCAGGCCCGGCCCGGTGCTGGGT

GCGCCGGGGGAGCTGGCGCTGGCGGGCGCAGCCGCCGCCTACCCCGGCA

AAGGGGCGGCCCCGTACGCGCCGCCCGCGCCCTCGCGCAGTGCCTTAGC

CCACCCCATCAGCCTTATGACGCTGCCCGGCGAGGCGGGCGCCGCGGGC

CTGGCACCGCCGGGCCACGCCGCCGCCTTCGGGGGCCCGCCCGGCGGCC

TCCTGCTGGACGCTCTGCCGGGGCCCTACGCTGCCGCCGCCGCCGGGCC

GCTGGGCGCCGCGCCCGACCGCTTCCCGGCCGACCTGGACCTCGACATG

TTCAGCGGGAGCCTCGAGTGCGACGTGGAGTCCATCATCCTCAACGACT

TCATGGACAGCGACGAAATGGACTTCAACTTCGATTCGGCCCTGCCTCC

GCCGCCGCCGGGCCTGGCCGGGGCCCCGCCCCCCAACCAGAGCTGGGTG

CCGGGC, or a nucleic acid sequence that hybridizes to a nucleic acid sequence consisting of SEQ ID NO:64 under stringent hybridization conditions.

In some embodiments, Forkheadbox P1 (FOXP1) comprises the amino acid sequence:

(SEQ ID NO: 65; NP_116071)

MMQESGTETKSNGSAIQNGSGGSNHLLECGGLREGRSNGETPAVDIGAA

DLAHAQQQQQQALQVARQLLLQQQQQQVSGLKSPKRNDKQPALQVPVS

VAMMTPQVITPQQMQQILQQQVLSPQQLQVLLQQQQALMLQQQQLQEFY

KKQQEQLQLQLLQQQHAGKQPKEQQQVATQQLAFQQQLLQMQQLQQQHL

LSLQRQGLLTIQPGQPALPLQPLAQGMIPTELQQLWKEVTSAHTAEETT

GNNHSSLDLTTTCVSSSAPSKTSLIMNPHASTNGQLSVHTPKRESLSHE

EHPHSHPLYGHGVCKWPGCEAVCEDFQSFLKHLNSEHALDDRSTAQCRV

QMQVVQQLELQLAKDKERLQAMMTHLHVKSTEPKAAPQPLNLVSSVTLS

KSASEASPQSLPHTPTTPTAPLTPVTQGPSVITTTSMHTVGPIRRRYSD

KYNVPISSADIAQNQEFYKNAEVRPPFTYASLIRQAILESPEKQLTLNE

IYNWFTRMFAYFRRNAATWKNAVRHNLSLHKCFVRVENVKGAVWTVDEV

-continued

EFQKRRPQKISGNPSLIKNMQSSHAYCTPLSAALQASMAENSIPLYTTA

SMGNPTLGNLASAIREELNGAMEHTNSNESDSSPGRSPMQAVHPVHVKE

EPLDPEEAEGPLSLVTTANHSPDFDHDRDYEDEPVNEDME, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:65.

In some embodiments, the nucleic acid sequence encoding FOXP1 comprises the nucleic acid sequence:

(SEQ ID NO: 66; NM_032682)

ATGATGCAAGAATCTGGGACTGAGACAAAAAGTAACGGTTCAGCCATCC

AGAATGGGTCGGGCGGCAGCAACCACTTACTAGAGTGCGGCGGTCTTCG

GGAGGGGCGGTCCAACGGAGAGACGCCGGCCGTGGACATCGGGGCAGCT

GACCTCGCCCACGCCCAGCAGCAGCAGCAACAGGCACTTCAGGTGGCAA

GACAGCTCCTTCTTCAGCAGCAACAGCAGCAGCAAGTTAGTGGATTAAA

ATCTCCCAAGAGGAATGACAAACAACCAGCTCTTCAGGTTCCCGTGTCA

GTGGCTATGATGACACCTCAAGTTATCACTCCCCAGCAAATGCAGCAGA

TCCTCCAGCAACAAGTGCTGAGCCCTCAGCAGCTCCAGGTTCTCCTCCA

GCAGCAGCAGGCCCTCATGCTTCAACAGCAGCAGCTTCAAGAGTTTTAT

AAAAAACAACAGGAACAGTTGCAGCTTCAACTTTTACAACAACAACATG

CTGGAAAACAGCCTAAAGAGCAACAGCAGGTGGCTACCCAGCAGTTGGC

TTTTCAGCAGCAGCTTTTACAGATGCAGCAGTTACAGCAGCAGCACCTC

CTGTCTTTGCAGCGCCAAGGCCTTCTGACAATTCAGCCCGGGCAGCCTG

CCCTTCCCCTTCAACCTCTTGCTCAAGGCATGATTCCAACAGAACTGCA

GCAGCTCTGGAAAGAAGTGACAAGTGCTCATACTGCAGAAGAAACCACA

GGCAACAATCACAGCAGTTTGGATCTGACCACGACATGTGTCTCCTCCT

CTGCACCTTCCAAGACCTCCTTAATAATGAACCCACATGCCTCTACCAA

TGGACAGCTCTCAGTCCACACTCCCAAAAGGGAAAGTTTGTCCCATGAG

GAGCACCCCCATAGCCATCCTCTCTATGGACATGGTGTATGCAAGTGGC

CAGGCTGTGAAGCAGTGTGCGAAGATTTCCAATCATTTCTAAAACATCT

CAACAGTGAGCATGCGCTGGACGATAGAAGTACAGCCCAATGTAGAGTA

CAAATGCAGGTTGTACAGCAGTTAGAGCTACAGCTTGCAAAAGACAAAG

AACGCCTGCAAGCCATGATGACCCACCTGCATGTGAAGTCTACAGAACC

CAAAGCCGCCCCTCAGCCCTTGAATCTGGTATCAAGTGTCACTCTCTCC

AAGTCCGCATCGGAGGCTTCTCCACAGAGCTTACCTCATACTCCAACGA

CCCCAACCGCCCCCCTGACTCCCGTCACCCAAGGCCCCTCTGTCATCAC

AACCACCAGCATGCACACGGTGGGACCCATCCGCAGGCGGTACTCAGAC

AAATACAACGTGCCCATTTCGTCAGCAGATATTGCGCAGAACCAAGAAT

TTTATAAGAACGCAGAAGTTAGACCACCATTTACATATGCATCTTTAAT

TAGGCAGGCCATTCTCGAATCTCCAGAAAAGCAGCTAACACTAAATGAG

ATCTATAACTGGTTCACACGAATGTTTGCTTACTTCCGACGCAACGCGG

-continued

```
CCACGTGGAAGAATGCAGTGCGTCATAATCTTAGTCTTCACAAGTGTTT
TGTGCGAGTAGAAAACGTTAAAGGGGCAGTATGGACAGTGGATGAAGTA
GAATTCCAAAAACGAAGGCCACAAAAGATCAGTGGTAACCCTTCCCTTA
TTAAAAACATGCAGAGCAGCCACGCCTACTGCACACCTCTCAGTGCAGC
TTTACAGGCTTCAATGGCTGAGAATAGTATACCTCTATACACTACCGCT
TCCATGGGAAATCCCACTCTGGGCAACTTAGCCAGCGCAATACGGGAAG
AGCTGAACGGGGCAATGGAGCATACCAACAGCAACGAGAGTGACAGCAG
TCCAGGCAGATCTCCTATGCAAGCCGTGCATCCTGTACACGTCAAAGAA
GAGCCCCTCGATCCAGAGGAAGCTGAAGGGCCCCTGTCCTTAGTGACAA
CAGCCAACCACAGTCCAGATTTTGACCATGACAGAGATTACGAAGATGA
ACCAGTAAACGAGGACATGGAG,
```

or a nucleic acid sequence that hybridizes to a nucleic acid sequence consisting of SEQ ID NO:66 under stringent hybridization conditions.

In some embodiments, Forkhead box P2 (FOXP2) comprises the amino acid sequence

```
                              (SEQ ID NO: 67; NP_055306)
MMQESATETISNSSMNQNGMSTLSSQLDAGSRDGRSSGDTSSEVSTVEL
LHLQQQQALQAARQLLLQQQTSGLKSPKSSDKQRPLQVPVSVAMMTPQV
ITPQQMQQILQQQVLSPQQLQALLQQQQAVMLQQQQLQEFYKKQQEQLH
LQLLQQQQQQQQQQQQQQQQQQQQQQQQQQQQQQQQQQQQQQQQHPGKQ
AKEQQQQQQQQQQLAAQQLVFQQQLLQMQQLQQQQHLLSLQRQGLISIP
PGQAALPVQSLPQAGLSPAEIQQLWKEVTGVHSMEDNGIKHGGLDLTTN
NSSSTTSSNTSKASPPITHHSIVNGQSSVLSARRDSSSHEETGASHTLY
GHGVCKWPGCESICEDFGQFLKHLNNEHALDDRSTAQCRVQMQVVQQLE
IQLSKERERLQAMMTHLHMRPSEPKPSPKPLNLVSSVTMSKNMLETSPQ
SLPQTPTTPTAPVTPITQGPSVITPASVPNVGAIRRRHSDKYNIPMSSE
IAPNYEFYKNADVRPPFTYATLIRQAIMESSDRQLTLNEIYSWFTRTFA
YFRRNAATWKNAVRHNLSLHKCFVRVENVKGAVWTVDEVEYQKRRSQKI
TGSPTLVKNIPTSLGYGAALNASLQAALAESSLPLLSNPGLINNASSGL
LQAVHEDLNGSLDHIDSNGNSSPGCSPQPHIHSIHVKEEPVIAEDEDCP
MSLVTTANHSPELEDDREIEEEPLSEDLE,
```

or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:67.

In some embodiments, the nucleic acid sequence encoding FOXP2 comprises the nucleic acid sequence:

```
                              (SEQ ID NO: 68; NM_014491)
ATGATGCAGGAATCTGCGACAGAGACAATAAGCAACAGTTCAATGAATC
AAAATGGAATGAGCACTCTAAGCAGCCAATTAGATGCTGGCAGCAGAGA
TGGAAGATCAAGTGGTGACACCAGCTCTGAAGTAAGCACAGTAGAACTG
CTGCATCTGCAACAACAGCAGGCTCTCCAGGCAGCAAGACAACTTCTTT
```

-continued

```
TACAGCAGCAAACAAGTGGATTGAAATCTCCTAAGAGCAGTGATAAACA
GAGACCACTGCAGGTGCCTGTGTCAGTGGCCATGATGACTCCCCAGGTG
ATCACCCCTCAGCAAATGCAGCAGATCCTTCAGCAACAAGTCCTGTCTC
CTCAGCAGCTACAAGCCCTTCTCCAACAACAGCAGGCTGTCATGCTGCA
GCAGCAACAACTACAAGAGTTTTACAAGAAACAGCAAGAGCAGTTACAT
CTTCAGCTTTTGCAGCAGCAGCAGCAACAGCAGCAGCAGCAACAACAGC
AGCAACAACAGCAGCAGCAACAACAACAACAACAGCAGCAACAACAGCA
GCAGCAGCAGCAACAGCAGCAGCAGCAGCAACAGCATCCTGGAAAGCAA
GCGAAAGAGCAGCAGCAGCAGCAGCAGCAGCAACAGCAATTGGCAGCCC
AGCAGCTTGTCTTCCAGCAGCAGCTTCTCCAGATGCAACAACTCCAGCA
GCAGCAGCATCTGCTCAGCCTTCAGCGTCAGGGACTCATCTCCATTCCA
CCTGGCCAGGCAGCACTTCCTGTCCAATCGCTGCCTCAAGCTGGCTTAA
GTCCTGCTGAGATTCAGCAGTTATGGAAAGAAGTGACTGGAGTTCACAG
TATGGAAGACAATGGCATTAAACATGGAGGGCTAGACCTCACTACTAAC
AATTCCTCCTCGACTACCTCCTCCAACACTTCCAAAGCATCACCACCAA
TAACTCATCATTCCATAGTGAATGGACAGTCTTCAGTTCTAAGTGCAAG
ACGAGACAGCTCGTCACATGAGGAGACTGGGGCCTCTCACACTCTCTAT
GGCCATGGAGTTTGCAAATGGCCAGGCTGTGAAAGCATTTGTGAAGATT
TTGGACAGTTTTTAAAGCACCTTAACAATGAACACGCATTGGATGACCG
AAGCACTGCTCAGTGTCGAGTGCAAATGCAGGTGGTGCAACAGTTAGAA
ATACAGCTTTCTAAAGAACGCGAACGTCTTCAAGCAATGATGACCCACT
TGCACATGCGACCCTCAGAGCCCAAACCATCTCCCAAACCTCTAAATCT
GGTGTCTAGTGTCACCATGTCGAAGAATATGTTGGAGACATCCCCACAG
AGCTTACCTCAAACCCCTACCACACCAACGGCCCCAGTCACCCCGATTA
CCCAGGGACCCTCAGTAATCACCCCAGCCAGTGTGCCCAATGTGGGAGC
CATACGAAGGCGACATTCAGACAAATACAACATTCCCATGTCATCAGAA
ATTGCCCCAAACTATGAATTTTATAAAAATGCAGATGTCAGACCTCCAT
TTACTTATGCAACTCTCATAAGGCAGGCTATCATGGAGTCATCTGACAG
GCAGTTAACACTTAATGAAATTTACAGCTGGTTTACACGGACATTTGCT
TACTTCAGGCGTAATGCAGCAACTTGGAAGAATGCAGTACGTCATAATC
TTAGCCTGCACAAGTGTTTTGTTCGAGTAGAAAATGTTAAAGGAGCAGT
ATGGACTGTGGATGAAGTAGAATACCAGAAGCGAAGGTCACAAAAGATA
ACAGGAAGTCCAACCTTAGTAAAAAATATACCTACCAGTTTAGGCTATG
GAGCAGCTCTTAATGCCAGTTTGCAGGCTGCCTTGGCAGAGAGCAGTTT
ACCTTTGCTAAGTAATCCTGGACTGATAAATAATGCATCCAGTGGCCTA
CTGCAGGCCGTCCACGAAGACCTCAATGGTTCTCTGGATCACATTGACA
GCAATGGAAACAGTAGTCCGGGCTGCTCACCTCAGCCGCACATACATTC
AATCCACGTCAAGGAAGAGCCAGTGATTGCAGAGGATGAAGACTGCCCA
ATGTCCTTAGTGACAACAGCTAATCACAGTCCAGAATTAGAAGACGACA
GAGAGATTGAAGAAGAGCCTTTATCTGAAGATCTGGAA,
```

or a nucleic acid sequence that hybridizes to a nucleic acid sequence consisting of SEQ ID NO:68 under stringent hybridization conditions.

In some embodiments, Forkhead box P3 (FOXP3) comprises the amino acid sequence (SEQ ID NO: 69; NP_054728)
MPNPRPGKPSAPSLALGPSPGASPSWRAAPKASDLLGARGPGGTFQGRD
LRGGAHASSSSLNPMPPSQLQLPTLPLVMVAPSGARLGPLPHLQALLQD
RPHFMHQLSTVDAHARTPVLQVHPLESPAMISLTPPTTATGVFSLKARP
GLPPGINVASLEWVSREPALLCTFPNPSAPRKDSTLSAVPQSSYPLLAN
GVCKWPGCEKVFEEPEDFLKHCQADHLLDEKGRAQCLLQREMVQSLEQQ
LVLEKEKLSAMQAHLAGKMALTKASSVASSDKGSCCIVAAGSQGPVVPA
WSGPREAPDSLFAVRRHLWGSHGNSTFPEFLHNMDYFKFHNMRPPFTYA
TLIRWAILEAPEKQRTLNEIYHWFTRMFAFFRNHPATWKNAIRHNLSLH
KCFVRVESEKGAVWTVDELEFRKKRSQRPSRCSNPTPGP, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:69.

In some embodiments, the nucleic acid sequence encoding FOXP3 comprises the nucleic acid sequence:

(SEQ ID NO: 70; NM_014009)
ATGCCCAACCCCAGGCCTGGCAAGCCCTCGGCCCCTTCCTTGGCCCTTG
GCCCATCCCCAGGAGCCTCGCCCAGCTGGAGGGCTGCACCCAAAGCCTC
AGACCTGCTGGGGGCCCGGGGCCCAGGGGGAACCTTCCAGGGCCGAGAT
CTTCGAGGCGGGGCCCATGCCTCCTCTTCTTCCTTGAACCCCATGCCAC
CATCGCAGCTGCAGCTGCCCACACTGCCCCTAGTCATGGTGGCACCCTC
CGGGGCACGGCTGGGCCCCTTGCCCCACTTACAGGCACTCCTCCAGGAC
AGGCCACATTTCATGCACCAGCTCTCAACGGTGGATGCCCACGCCCGGA
CCCCTGTGCTGCAGGTGCACCCCCTGGAGAGCCCAGCCATGATCAGCCT
CACACCACCCACCACCGCCACTGGGGTCTTCTCCCTCAAGGCCCGGCCT
GGCCTCCCACCTGGGATCAACGTGGCCAGCCTGGAATGGGTGTCCAGGG
AGCCGGCACTGCTCTGCACCTTCCCAAATCCCAGTGCACCCAGGAAGGA
CAGCACCCTTTCGGCTGTGCCCCAGAGCTCCTACCCACTGCTGGCAAAT
GGTGTCTGCAAGTGGCCCGGATGTGAGAAGGTCTTCGAAGAGCCAGAGG
ACTTCCTCAAGCACTGCCAGGCGGACCATCTTCTGGATGAGAAGGGCAG
GGCACAATGTCTCCTCCAGAGAGAGATGGTACAGTCTCTGGAGCAGCAG
CTGGTGCTGGAGAAGGAGAAGCTGAGTGCCATGCAGGCCCACCTGGCTG
GGAAAATGGCACTGACCAAGGCTTCATCTGTGGCATCATCCGACAAGGG
CTCCTGCTGCATCGTAGCTGCTGGCAGCCAAGGCCCTGTCGTCCCAGCC
TGGTCTGGCCCCCGGGAGGCCCCTGACAGCCTGTTTGCTGTCCGGAGGC
ACCTGTGGGGTAGCCATGGAAACAGCACATTCCCAGAGTTCCTCCACAA
CATGGACTACTTCAAGTTCCACAACATGCGACCCCCTTTCACCTACGCC
ACGCTCATCCGCTGGGCCATCCTGGAGGCTCCAGAGAAGCAGCGGACAC

-continued
TCAATGAGATCTACCACTGGTTCACACGCATGTTTGCCTTCTTCAGAAA
CCATCCTGCCACCTGGAAGAACGCCATCCGCCACAACCTGAGTCTGCAC
AAGTGCTTTGTGCGGGTGGAGAGCGAGAAGGGGGCTGTGTGGACCGTGG
ATGAGCTGGAGTTCCGCAAGAAACGGAGCCAGAGGCCCAGCAGGTGTTC
CAACCCTACACCTGGCCCC, or a nucleic acid sequence that hybridizes to a nucleic acid sequence consisting of SEQ ID NO:70 under stringent hybridization conditions.

In some embodiments, Forkhead box 4 (FOXP4) comprises the amino acid sequence:

(SEQ ID NO: 71 NP_001012426)
MMVESASETIRSAPSGQNGVGSLSGQADGSSGGATGTTASGTGREVTTG
ADSNGEMSPAELLHFQQQQALQVARQFLLQQASGLSSPGNNDSKQSASA
VQVPVSVAMMSPQMLTPQQMQQILSPPQLQALLQQQQALMLQQEYYKKQ
QEQLHLQLLTQQQAGKPQPKEALGNKQLAFQQQLLQMQQLQQQHLLNLQ
RQGLVSLQPNQASGPLQTLPQAAVCPTDLPQLWKGEGAPGQPAEDSVKQ
EGLDLTGTAATATSFAAPPKVSPPLSHHTLPNGQPTVLTSRRDSSSHEE
TPGSHPLYGHGECKWPGCETLCEDLGQFIKHLNTEHALDDRSTAQCRVQ
MQVVQQLEIQLAKESERLQAMMAHLHMRPSEPKPFSQPLNPVPGSSSFS
KVTVSAADSFPDGLVHPPTSAAAPVTPLRPPGLGSASLHGGGPARRRSS
DKFCSPISSELAQNHEFYKNADVRPPFTYASLIRQAILETPDRQLTLNE
IYNWFTRMFAYFRRNTATWKNAVRHNLSLHKCFVRVENVKGAVWTVDER
EYQKRRPPKMTGSPTLVKNMISGLSYGALNASYQAALAESSFPLLNSPG
MLNPGSASSLLPLSHDDVGAPVEPLPSNGSSSPPRLSPPQYSHQVQVKE
EPAEAEEDRQPGPPLGAPNPSASGPPEDRDLEEELPGEELS, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:71.

In some embodiments, the nucleic acid sequence encoding FOXP4 comprises the nucleic acid sequence:

(SEQ ID NO: 72; NM_001012426)
ATGATGGTGGAATCTGCCTCGGAGACAATCAGGTCGGCTCCATCTGGTC
AGAATGGCGTGGGCAGCCTCTCTGGGCAAGCAGATGGCAGCAGCGGCGG
GGCCACAGGGACAACTGCAAGTGGCACGGGCAGGGAAGTGACCACGGGT
GCAGACAGCAATGGTGAGATGAGTCCCGCAGAGCTGCTGCACTTCCAGC
AGCAACAGGCTCTCCAAGTGGCCCGGCAGTTCCTGCTGCAGCAGGCCTC
AGGCCTGAGCTCCCCAGGGAACAATGACAGCAAACAGTCTGCCTCTGCT
GTGCAGGTGCCTGTGTCGGTGGCCATGATGTCGCCGCAGATGCTTACCC
CGCAACAGATGCAGCAGATCCTGTCGCCCCCGCAGCTGCAGGCCTTGCT
CCAGCAGCAGCAAGCCCTCATGCTCCAGCAGGAGTACTACAAGAAGCAG
CAGGAGCAGCTCCACCTGCAGCTCCTCACCCAGCAGCAGGCTGGGAAAC

-continued

```
CGCAGCCCAAAGAGGCACTGGGGAACAAGCAGCTGGCCTTCCAGCAGCA
GCTCCTGCAAATGCAACAGTTGCAGCAGCAGCACCTGCTCAACCTGCAG
AGGCAGGGGCTGGTCAGCCTGCAGCCCAACCAAGCCTCGGGGCCCCTCC
AGACCCTTCCGCAAGCAGCTGTTTGCCCAACAGACCTGCCCCAGCTGTG
GAAGGGCGAGGGTGCCCCCGGGCAGCCTGCCGAGGACAGCGTCAAGCAG
GAGGGGCTGGACCTCACTGGCACGGCCGCCACCGCTACCTCGTTTGCCG
CTCCCCCCAAGGTCTCACCCCCCCTCTCCCACCATACCCTGCCCAACGG
ACAGCCTACTGTGCTCACATCTCGGAGAGACAGCTCTTCCCACGAGGAG
ACCCCCGGCTCCCACCCCCTGTACGGACACGGAGAGTGCAAGTGGCCAG
GCTGTGAGACCCTGTGTGAAGACCTGGGCCAGTTTATCAAACACCTCAA
CACAGAGCACGCCCTGGATGACCGGAGTACAGCCCAGTGCCGGGTACAG
ATGCAGGTGGTGCAGCAGCTGGAGATCCAGCTCGCCAAGGAGAGCGAGC
GGCTGCAGGCCATGATGGCCCACCTGCACATGCGGCCCTCGGAGCCCAA
GCCCTTCAGCCAGCCACTGAACCCGGTCCCCGGCTCCTCCTCATTCTCC
AAGGTGACCGTCTCTGCAGCAGACTCATTCCCAGATGGTCTCGTGCACC
CCCCGACCTCGGCCGCAGCCCCTGTCACCCCTCTACGGCCCCCTGGCCT
GGGCTCTGCCTCCCTGCATGGTGGGGGCCCAGCCCGTCGGAGAAGCAGT
GACAAGTTCTGCTCCCCCATCTCCTCAGAGCTGGCCCAGAATCATGAGT
TCTACAAGAACGCCGACGTCCGGCCCCCCTTCACCTACGCCTCCCTCAT
CCGCCAGGCCATCCTGGAAACCCCTGACAGGCAGCTGACCCTGAATGAG
ATCTATAACTGGTTCACCAGGATGTTCGCCTATTTCCGCAGAAACACTG
CCACCTGGAAGAACGCCGTGCGCCACAACCTCAGCCTGCACAAGTGCTT
CGTCCGCGTGGAGAACGTCAAGGGTGCCGTGTGGACTGTGGACGAGCGG
GAGTATCAGAAGCGGAGACCGCCAAAGATGACAGGGAGCCCCACCCTGG
TGAAGAACATGATCTCTGGCCTCAGCTATGGAGCACTTAATGCCAGCTA
CCAGGCCGCCCTGGCCGAGAGCAGCTTCCCCCTCCTCAACAGCCCTGGC
ATGCTGAACCCTGGCTCCGCCAGCAGCCTGCTGCCCCTCAGCCACGATG
ACGTGGGTGCCCCCGTGGAGCCGCTGCCCAGCAACGGCAGCAGCAGCCC
TCCTCGCCTCTCCCCGCCCCAGTACAGCCACCAGGTGCAGGTGAAGGAG
GAGCCAGCAGAGGCAGAGGAAGACAGGCAGCCCGGGCCTCCCCTGGGCG
CCCCTAACCCCAGCGCCTCGGGGCCTCCGGAAGACAGGGACCTGGAGGA
GGAGCTGCCGGGAGAAGAACTGTCC,
```

or a nucleic acid sequence that hybridizes to a nucleic acid sequence consisting of SEQ ID NO:72 under stringent hybridization conditions.

In some embodiments, Forkhead box Q1 (FOXQ1) comprises the amino acid sequence:

```
                                    (SEQ ID NO: 73; NP_150285)
MKLEVFVPRAAHGDKQGSDLEGAGGSDAPSPLSAAGDDSLGSDGDCAAN
SPAAGGGARDPPGDGEQSAGGGPGAEEAIPAAAAAAVVAEGAEAGAAGP
GAGGAGSGEGARSKPYTRRPKPPYSYIALIAMAIRDSAGGRLTLAEINE
YLMGKFPFFRGSYTGWRNSVRHNLSLNDCFVKVLRDPSRPWGKDNYWML
```

-continued

```
NPNSEYTFADGVFRRRRKRLSHRAPVPAPGLRPEEAPGLPAAPPPAPAA
PASPRMRSPARQEERASPAGKFSSSFAIDSILRKPFRSRRLRDTAPGTT
LQWGAAPCPPLPAFPALLPAAPCRALLPLCAYGAGEPARLGAREAEVPP
TAPPLLLAPLPAAAPAKPLRGPAAGGAHLYCPLRLPAALQAASVRRPGP
HLPYPVETLLA,
```

or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:73.

In some embodiments, the nucleic acid sequence encoding FOXQ1 comprises the nucleic acid sequence:

```
                                    (SEQ ID NO: 74; NM_033260)
ATGAAGTTGGAGGTGTTCGTCCCTCGCGCGGCCCACGGGGACAAGCAGG
GCAGTGACCTGGAGGGCGCGGGCGGCAGCGACGCGCCGTCCCCGCTGTC
GGCGGCGGGAGACGACTCCCTGGGCTCAGATGGGGACTGCGCGGCCAAC
AGCCCGGCCGCGGGCGGCGGCGCCAGAGATCCGCCGGGCGACGGCGAAC
AGAGTGCGGGAGGCGGGCCGGGCGCGGAGGAGGCGATCCCGGCAGCAGC
TGCTGCAGCGGTGGTGGCGGAGGGCGCGGAGGCCGGGGCGGCGGGGCCA
GGCGCGGGCGGCGCGGGGAGCGGCGAGGGTGCACGCAGCAAGCCATATA
CGCGGCGGCCCAAGCCCCCCTACTCGTACATCGCGCTCATCGCCATGGC
CATCCGCGACTCGGCGGGCGGGCGCTTGACGCTGGCGGAGATCAACGAG
TACCTCATGGGCAAGTTCCCCTTTTTCCGCGGCAGCTACACGGGCTGGC
GCAACTCCGTGCGCCACAACCTTTCGCTCAACGACTGCTTCGTCAAGGT
GCTGCGCGACCCCTCGCGGCCCTGGGGCAAGGACAACTACTGGATGCTC
AACCCCAACAGCGAGTACACCTTCGCCGACGGGGTCTTCCGCCGCCGCC
GCAAGCGCCTCAGCCACCGCGCGCCGGTCCCCGCGCCCGGGCTGCGGCC
CGAGGAGGCCCCGGGCCTCCCCGCCGCCCCGCCGCCCGCGCCCGCCGCC
CCGGCCTCGCCCCGCATGCGCTCGCCCGCCCGCCAGGAGGAGCGCGCCA
GCCCCGCGGGCAAGTTCTCCAGCTCCTTCGCCATCGACAGCATCCTGCG
CAAGCCCTTCCGCAGCCGCCGCCTCAGGGACACGGCCCCCGGGACGACG
CTTCAGTGGGGCGCCGCGCCCTGCCCGCCGCTGCCCGCGTTCCCCGCGC
TCCTCCCCGCGGCGCCCTGCAGGGCCCTGCTGCCGCTCTGCGCGTACGG
CGCGGGCGAGCCGGCGCGGCTGGGCGCGCGCGAGGCCGAGGTGCCACCG
ACCGCGCCGCCCCTCCTGCTTGCACCTCTCCCGGCGGCGGCCCCCGCCA
AGCCACTCCGAGGCCCGGCGGCCGGCGGCGCGCACCTGTACTGCCCCCT
GCGGCTGCCCGCAGCCCTGCAGGCGGCCTCAGTCCGCCGCCCTGGCCCG
CACCTGCCGTACCCGGTGGAGACGCTCCTAGCC,
```

or a nucleic acid sequence that hybridizes to a nucleic acid sequence consisting of SEQ ID NO:74 under stringent hybridization conditions.

In some embodiments, Forkhead Box R1 (FOXR1) comprises the amino acid sequence:

(SEQ ID NO: 75; NP_859072)
MGNELFLAFTTSHLPLAEQKLARYKLRIVKPPKLPLEKKPNPDKDGPDY

EPNLWMWVNPNIVYPPGKLEVSGRRKREDLTSTLPSSQPPQKEEDASCS

EAAGVESLSQSSSKRSPPRKRFAFSPSTWELTEEEEAEDQEDSSSMALP

SPHKRAPLQSRRLRQASSQAGRLWSRPPLNYFHLIALALRNSSPCGLNV

QQIYSFTRKHFPFFRTAPEGWKNTVRHNLCFRDSFEKVPVSMQGGASTR

PRSCLWKLTEEGHRRFAEEARALASTRLESIQQCMSQPDVMPFLFDL, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:75.

In some embodiments, the nucleic acid sequence encoding FOXR1 comprises the nucleic acid sequence:

(SEQ ID NO: 76; NM_181721)
ATGGGGAACGAGCTCTTTCTGGCCTTCACCACATCTCACCTCCCCTTAG

CGGAGCAGAAACTTGCCAGGTATAAACTCCGAATTGTTAAGCCACCAAA

ATTACCCCTAGAGAAAAAACCCAACCCTGATAAGGATGGTCCAGATTAT

GAGCCCAACCTCTGGATGTGGGTAAATCCCAACATTGTGTATCCCCCTG

GAAAGCTGGAGGTCTCAGGACGTAGGAAGAGGGAGGACCTGACAAGCAC

ACTCCCCTCCTCTCAGCCACCCCAGAAGGAGGAAGATGCCAGCTGCTCA

GAGGCCGCAGGGGTGGAATCACTGTCCCAGTCCTCCAGCAAGCGGTCTC

CCCCTCGGAAGCGGTTTGCCTTTTCCCCCAGCACCTGGGAGCTCACAGA

AGAGGAGGAGGCTGAGGACCAGGAAGACAGCTCCTCTATGGCTCTCCCA

TCCCCTCACAAAAGGGCCCCCCTCCAGAGTCGGAGGCTTCGGCAAGCCA

GCAGCCAGGCGGGGAGGCTCTGGTCCCGGCCCCCTCTCAATTACTTCCA

CCTAATTGCCCTGGCATTAAGAAACAGTTCCCCCTGTGGCCTCAACGTG

CAACAGATCTACAGTTTCACTCGAAAGCACTTCCCCTTTTTCCGGACGG

CCCCGGAAGGCTGGAAGAATACTGTCCGTCACAATCTCTGTTTTCGAGA

CAGCTTTGAGAAAGTGCCTGTCAGCATGCAGGGCGGGGCCAGCACACGG

CCTCGATCTTGCCTCTGGAAGTTGACCGAGGAGGGACACCGCCGCTTTG

CGGAGGAGGCCCGCGCCTTGGCTTCCACTCGGCTAGAAAGTATCCAACA

GTGCATGAGCCAGCCAGATGTGATGCCCTTCCTCTTTGATCTT, or a nucleic acid sequence that hybridizes to a nucleic acid sequence consisting of SEQ ID NO:76 under stringent hybridization conditions.

In some embodiments, FOXR2 comprises the amino acid sequence (SEQ ID NO: 77; NP_940853)
MDLKLKDCEFWYSLHGQVPGLLDWDMRNELFLPCTTDQCSLAEQILAKY

RVGVMKPPEMPQKRRPSPDGDGPPCEPNLWMWVDPNILCPLGSQEAPKP

SGKEDLTNISPFPQPPQKDEGSNCSEDKVVESLPSSSSEQSPLQKQGIH

SPSDFELTEEEAEEPDDNSLQSPEMKCYQSQKLWQINNQEKSWQRPPLN

-continued

CSHLIALALRNNPHCGLSVQEIYNFTRQHFPFFWTAPDGWKSTIHYNLC

FLDSFEKVPDSLKDEDNARPRSCLWKLTKEGHRRFWEETRVLAFAQRER

IQECMSQPELLTSLFDL, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:77.

In some embodiments, the nucleic acid sequence encoding FOXR2 comprises the nucleic acid sequence:

(SEQ ID NO: 78; NM_198451)
ATGGACTTAAAACTAAAAGACTGTGAATTTTGGTATAGTCTCCATGGCC

AGGTCCCAGGGCTGCTGGACTGGGACATGAGGAATGAGTTATTTCTGCC

TTGTACCACAGACCAGTGCTCTTTAGCTGAGCAAATCCTTGCCAAATAC

AGAGTCGGAGTAATGAAGCCCCCAGAAATGCCTCAGAAGAGGAGACCCA

GTCCTGATGGAGATGGTCCTCCCTGTGAACCCAATCTGTGGATGTGGGT

GGACCCCAATATCCTGTGCCCCCTTGGCAGCCAGGAGGCCCCAAAGCCC

AGTGGAAAAGAGGATCTGACAAACATTTCTCCTTTCCCTCAGCCCCCAC

AAAAAGACGAAGGGTCTAACTGCTCAGAGGACAAAGTGGTAGAGTCTCT

GCCATCTTCCTCCAGTGAGCAGTCTCCTTTACAGAAGCAGGGTATCCAT

TCCCCCAGTGACTTTGAGCTCACAGAAGAGGAGGCTGAGGAACCAGACG

ACAACTCCCTCCAGTCCCCTGAAATGAAATGTTACCAGAGCCAGAAACT

ATGGCAAATCAACAACCAAGAGAAGTCCTGGCAAAGGCCCCCTCTCAAT

TGTAGCCACCTTATTGCCCTAGCATTAAGAAACAACCCCCACTGTGGCC

TCAGTGTGCAGGAGATCTACAATTTCACCCGACAGCATTTCCCCTTTTT

CTGGACAGCTCCGGATGGCTGGAAGAGCACCATTCATTACAACCTCTGC

TTCCTGGACAGCTTTGAGAAGGTGCCAGACAGCCTTAAGGATGAAGATA

ATGCAAGACCTCGCTCTTGCCTTTGGAAGCTCACTAAGGAGGGGCACCG

CCGCTTTTGGGAGGAGACTCGTGTCTTAGCCTTTGCTCAAAGGGAGAGA

ATCCAAGAGTGCATGAGTCAGCCAGAGTTGTTGACCTCTCTCTTTGATC

TT, or a nucleic acid sequence that hybridizes to a nucleic acid sequence consisting of SEQ ID NO:78 under stringent hybridization conditions.

In some embodiments, Hypoxia inducible factor 1 subunit alpha (HIF-1a) comprises the amino acid sequence:

(SEQ ID NO: 79; NP_001521)
MEGAGGANDKKKISSERRKEKSRDAARSRRSKESEVFYELAHQLPLPHN

VSSHLDKASVMRLTISYLRVRKLLDAGDLDIEDDMKAQMNCFYLKALDG

FVMVLTDDGDMIYISDNVNKYMGLTQFELTGHSVFDFTHPCDHEEMREM

LTHRNGLVKKGKEQNTQRSFFLRMKCTLTSRGRTMNIKSATWKVLHCTG

HIHVYDTNSNQPQCGYKKPPMTCLVLICEPIPHPSNIEIPLDSKTFLSR

HSLDMKFSYCDERITELMGYEPEELLGRSIYEYYHALDSDHLTKTHHDM

-continued

```
FTKGQVTTGQYRMLAKRGGYVWVETQATVIYNTKNSQPQCIVCVNYVVS
GIIQHDLIFSLQQTECVLKPVESSDMKMTQLFTKVESEDTSSLFDKLKK
EPDALTLLAPAAGDTIISLDFGSNDTETDDQQLEEVPLYNDVMLPSPNE
KLQNINLAMSPLPTAETPKPLRSSADPALNQEVALKLEPNPESLELSFT
MPQIQDQTPSPSDGSTRQSSPEPNSPSEYCFYVDSDMVNEFKLELVEKL
FAEDTEAKNPFSTQDTDLDLEMLAPYIPMDDDFQLRSFDQLSPLESSSA
SPESASPQSTVTVFQQTQIQEPTANATTTTATTDELKTVTKDRMEDIKI
LIASPSPTHIHKETTSATSSPYRDTQSRTASPNRAGKGVIEQTEKSHPR
SPNVLSVALSQRTTVPEEELNPKILALQNAQRKRKMEHDGSLFQAVGIG
TLLQQPDDHAATTSLSWKRVKGCKSSEQNGMEQKTIILIPSDLACRLLG
QSMDESGLPQLTSYDCEVNAPIQGSRNLLQGEELLRALDQVN,
```

or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:79.

In some embodiments, the nucleic acid sequence encoding HIF-1a comprises the nucleic acid sequence:

```
(SEQ ID NO: 80; NM_001530)
ATGGAGGGCGCCGGCGGCGCGAACGACAAGAAAAAGATAAGTTCTGAAC
GTCGAAAAGAAAAGTCTCGAGATGCAGCCAGATCTCGGCGAAGTAAAGA
ATCTGAAGTTTTTTATGAGCTTGCTCATCAGTTGCCACTTCCACATAAT
GTGAGTTCGCATCTTGATAAGGCCTCTGTGATGAGGCTTACCATCAGCT
ATTTGCGTGTGAGGAAACTTCTGGATGCTGGTGATTTGGATATTGAAGA
TGACATGAAAGCACAGATGAATTGCTTTTATTTGAAAGCCTTGGATGGT
TTTGTTATGGTTCTCACAGATGATGGTGACATGATTTACATTTCTGATA
ATGTGAACAAATACATGGGATTAACTCAGTTTGAACTAACTGGACACAG
TGTGTTTGATTTTACTCATCCATGTGACCATGAGGAAATGAGAGAAATG
CTTACACACAGAAATGGCCTTGTGAAAAAGGGTAAAGAACAAAACACAC
AGCGAAGCTTTTTTCTCAGAATGAAGTGTACCCTAACTAGCCGAGGAAG
AACTATGAACATAAAGTCTGCAACATGGAAGGTATTGCACTGCACAGGC
CACATTCACGTATATGATACCAACAGTAACCAACCTCAGTGTGGGTATA
AGAAACCACCTATGACCTGCTTGGTGCTGATTTGTGAACCCATTCCTCA
CCCATCAAATATTGAAATTCCTTTAGATAGCAAGACTTTCCTCAGTCGA
CACAGCCTGGATATGAAATTTTCTTATTGTGATGAAAGAATTACCGAAT
TGATGGGATATGAGCCAGAAGAACTTTTAGGCCGCTCAATTTATGAATA
TTATCATGCTTTGGACTCTGATCATCTGACCAAAACTCATCATGATATG
TTTACTAAAGGACAAGTCACCACAGGACAGTACAGGATGCTTGCCAAAA
GAGGTGGATATGTCTGGGTTGAAACTCAAGCAACTGTCATATATAACAC
CAAGAATTCTCAACCACAGTGCATTGTATGTGTGAATTACGTTGTGAGT
GGTATTATTCAGCACGACTTGATTTTCTCCCTTCAACAAACAGAATGTG
TCCTTAAACCGGTTGAATCTTCAGATATGAAAATGACTCAGCTATTCAC
CAAAGTTGAATCAGAAGATACAAGTAGCCTCTTTGACAAACTTAAGAAG
```

-continued

```
GAACCTGATGCTTTAACTTTGCTGGCCCCAGCCGCTGGAGACACAATCA
TATCTTTAGATTTTGGCAGCAACGACACAGAAACTGATGACCAGCAACT
TGAGGAAGTACCATTATATAATGATGTAATGCTCCCCTCACCCAACGAA
AAATTACAGAATATAAATTTGGCAATGTCTCCATTACCCACCGCTGAAA
CGCCAAAGCCACTTCGAAGTAGTGCTGACCCTGCACTCAATCAAGAAGT
TGCATTAAAATTAGAACCAAATCCAGAGTCACTGGAACTTTCTTTTACC
ATGCCCCAGATTCAGGATCAGACACCTAGTCCTTCCGATGGAAGCACTA
GACAAAGTTCACCTGAGCCTAATAGTCCCAGTGAATATTGTTTTTATGT
GGATAGTGATATGGTCAATGAATTCAAGTTGGAATTGGTAGAAAAACTT
TTTGCTGAAGACACAGAAGCAAAGAACCCATTTTCTACTCAGGACACAG
ATTTAGACTTGGAGATGTTAGCTCCCTATATCCCAATGGATGATGACTT
CCAGTTACGTTCCTTCGATCAGTTGTCACCATTAGAAAGCAGTTCCGCA
AGCCCTGAAAGCGCAAGTCCTCAAAGCACAGTTACAGTATTCCAGCAGA
CTCAAATACAAGAACCTACTGCTAATGCCACCACTACCACTGCCACCAC
TGATGAATTAAAAACAGTGACAAAAGACCGTATGGAAGACATTAAAATA
TTGATTGCATCTCCATCTCCTACCCACATACATAAAGAAACTACTAGTG
CCACATCATCACCATATAGAGATACTCAAAGTCGGACAGCCTCACCAAA
CAGAGCAGGAAAAGGAGTCATAGAACAGACAGAAAAATCTCATCCAAGA
AGCCCTAACGTGTTATCTGTCGCTTTGAGTCAAAGAACTACAGTTCCTG
AGGAAGAACTAAATCCAAAGATACTAGCTTTGCAGAATGCTCAGAGAAA
GCGAAAAATGGAACATGATGGTTCACTTTTTCAAGCAGTAGGAATTGGA
ACATTATTACAGCAGCCAGACGATCATGCAGCTACTACATCACTTTCTT
GGAAACGTGTAAAAGGATGCAAATCTAGTGAACAGAATGGAATGGAGCA
AAAGACAATTATTTTAATACCCTCTGATTTAGCATGTAGACTGCTGGGG
CAATCAATGGATGAAAGTGGATTACCACAGCTGACCAGTTATGATTGTG
AAGTTAATGCTCCTATACAAGGCAGCAGAAACCTACTGCAGGGTGAAGA
ATTACTCAGAGCTTTGGATCAAGTTAAC,
```

or a nucleic acid sequence that hybridizes to a nucleic acid sequence consisting of SEQ ID NO:80 under stringent hybridization conditions.

In some embodiments, endothelial PAS domain protein 1 (HIF-2a/EPAS1) comprises the amino acid sequence:

```
(SEQ ID NO: 81; NP_001421)
MTADKEKKRSSSERRKEKSRDAARCRRSKETEVFYELAHELPLPHSVSS
HLDKASIMRLAISFLRTHKLLSSVCSENESEAEADQQMDNLYLKALEGF
IAVVTQDGDMIFLSENISKFMGLTQVELTGHSIFDFTHPCDHEEIRENL
SLKNGSGFGKKSKDMSTERDFFMRMKCTVTNRGRTVNLKSATWKVLHCT
GQVKVYNNCPPHNSLCGYKEPLLSCLIIMCEPIQHPSHMDIPLDSKTFL
SRHSMDMKFTYCDDRITELIGYHPEELLGRSAYEFYHALDSENMTKSHQ
NLCTKGQVVSGQYRMLAKHGGYVWLETQGTVIYNPRNLQPQCIMCVNYV
LSEIEKNDVVFSMDQTESLFKPHLMAMNSIFDSSGKGAVSEKSNFLFTK
```

-continued

```
LKEEPEELAQLAPTPGDAIISLDFGNQNFEESSAYGKAILPPSQPWATE

LRSHSTQSEAGSLPAFTVPQAAAPGSTTPSATSSSSSCSTPNSPEDYYT

SLDNDLKIEVIEKLFAMDTEAKDQCSTQTDFNELDLETLAPYIPMDGED

FQLSPICPEERLLAENPQSTPQHCFSAMTNIFQPLAPVAPHSPFLLDKF

QQQLESKKTEPEHRPMSSIFFDAGSKASLPPCCGQASTPLSSMGGRSNT

QWPPDPPLHFGPTKWAVGDQRTEFLGAAPLGPPVSPPHVSTFKTRSAKG

FGARGPDVLSPAMVALSNKLKLKRQLEYEEQAFQDLSGGDPPGGSTSHL

MWKRMKNLRGGSCPLMPDKPLSANVPNDKFTQNPMRGLGHPLRHLPLPQ

PPSAISPGENSKSRFPPQCYATQYQDYSLSSAHKVSGMASRLLGPSFES

YLLPELTRYDCEVNVPVLGSSTLLQGGDLLRALDQAT,
```

or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:81.

In some embodiments, the nucleic acid sequence encoding HIF-2a comprises the nucleic acid sequence:

```
                                (SEQ ID NO: 82; NM_001430)
ATGACAGCTGACAAGGAGAAGAAAAGGAGTAGCTCGGAGAGGAGGAAGG

AGAAGTCCCGGGATGCTGCGCGGTGCCGGCGGAGCAAGGAGACGGAGGT

GTTCTATGAGCTGGCCCATGAGCTGCCTCTGCCCCACAGTGTGAGCTCC

CATCTGGACAAGGCCTCCATCATGCGACTGGCAATCAGCTTCCTGCGAA

CACACAAGCTCCTCTCCTCAGTTTGCTCTGAAAACGAGTCCGAAGCCGA

AGCTGACCAGCAGATGGACAACTTGTACCTGAAAGCCTTGGAGGGTTTC

ATTGCCGTGGTGACCCAAGATGGCGACATGATCTTTCTGTCAGAAAACA

TCAGCAAGTTCATGGGACTTACACAGGTGGAGCTAACAGGACATAGTAT

CTTTGACTTCACTCATCCCTGCGACCATGAGGAGATTCGTGAGAACCTG

AGTCTCAAAAATGGCTCTGGTTTTGGGAAAAAAAGCAAAGACATGTCCA

CAGAGCGGGACTTCTTCATGAGGATGAAGTGCACGGTCACCAACAGAGG

CCGTACTGTCAACCTCAAGTCAGCCACCTGGAAGGTCTTGCACTGCACG

GGCCAGGTGAAAGTCTACAACAACTGCCCTCCTCACAATAGTCTGTGTG

GCTACAAGGAGCCCCTGCTGTCCTGCCTCATCATCATGTGTGAACCAAT

CCAGCACCCATCCCACATGGACATCCCCCTGGATAGCAAGACCTTCCTG

AGCCGCCACAGCATGGACATGAAGTTCACCTACTGTGATGACAGAATCA

CAGAACTGATTGGTTACCACCCTGAGGAGCTGCTTGGCCGCTCAGCCTA

TGAATTCTACCATGCGCTAGACTCCGAGAACATGACCAAGAGTCACCAG

AACTTGTGCACCAAGGGTCAGGTAGTAAGTGGCCAGTACCGGATGCTCG

CAAAGCATGGGGGCTACGTGTGGCTGGAGACCCAGGGGACGGTCATCTA

CAACCCTCGCAACCTGCAGCCCCAGTGCATCATGTGTGTCAACTACGTC

CTGAGTGAGATTGAGAAGAATGACGTGGTGTTCTCCATGGACCAGACTG

AATCCCTGTTCAAGCCCCACCTGATGGCCATGAACAGCATCTTTGATAG

CAGTGGCAAGGGGGCTGTGTCTGAGAAGAGTAACTTCCTATTCACCAAG

CTAAAGGAGGAGCCCGAGGAGCTGGCCCAGCTGGCTCCCACCCCAGGAG
```

-continued

```
ACGCCATCATCTCTCTGGATTTCGGGAATCAGAACTTCGAGGAGTCCTC

AGCCTATGGCAAGGCCATCCTGCCCCCGAGCCAGCCATGGGCCACGGAG

TTGAGGAGCCACAGCACCCAGAGCGAGGCTGGGAGCCTGCCTGCCTTCA

CCGTGCCCCAGGCAGCTGCCCCGGGCAGCACCACCCCCAGTGCCACCAG

CAGCAGCAGCAGCTGCTCCACGCCCAATAGCCCTGAAGACTATTACACA

TCTTTGGATAACGACCTGAAGATTGAAGTGATTGAGAAGCTCTTCGCCA

TGGACACAGAGGCCAAGGACCAATGCAGTACCCAGACGGATTTCAATGA

GCTGGACTTGGAGACACTGGCACCCTATATCCCCATGGACGGGGAAGAC

TTCCAGCTAAGCCCCATCTGCCCCGAGGAGCGGCTCTTGGCGGAGAACC

CACAGTCCACCCCCCAGCACTGCTTCAGTGCCATGACAAACATCTTCCA

GCCACTGGCCCCTGTAGCCCCGCACAGTCCCTTCCTCCTGGACAAGTTT

CAGCAGCAGCTGGAGAGCAAGAAGACAGAGCCCGAGCACCGGCCCATGT

CCTCCATCTTCTTTGATGCCGGAAGCAAAGCATCCCTGCCACCGTGCTG

TGGCCAGGCCAGCACCCCTCTCTCTTCCATGGGGGGCAGATCCAATACC

CAGTGGCCCCCAGATCCACCATTACATTTTGGGCCCACAAAGTGGGCCG

TCGGGGATCAGCGCACAGAGTTCTTGGGAGCAGCGCCGTTGGGGCCCCC

TGTCTCTCCACCCCATGTCTCCACCTTCAAGACAAGGTCTGCAAAGGGT

TTTGGGGCTCGAGGCCCAGACGTGCTGAGTCCGGCCATGGTAGCCCTCT

CCAACAAGCTGAAGCTGAAGCGACAGCTGGAGTATGAAGAGCAAGCCTT

CCAGGACCTGAGCGGGGGGGACCCACCTGGTGGCAGCACCTCACATTTG

ATGTGGAAACGGATGAAGAACCTCAGGGGTGGGAGCTGCCCTTTGATGC

CGGACAAGCCACTGAGCGCAAATGTACCCAATGATAAGTTCACCCAAAA

CCCCATGAGGGGCCTGGGCCATCCCCTGAGACATCTGCCGCTGCCACAG

CCTCCATCTGCCATCAGTCCCGGGGAGAACAGCAAGAGCAGGTTCCCCC

CACAGTGCTACGCCACCCAGTACCAGGACTACAGCCTGTCGTCAGCCCA

CAAGGTGTCAGGCATGGCAAGCCGGCTGCTCGGGCCCTCATTTGAGTCC

TACCTGCTGCCCGAACTGACCAGATATGACTGTGAGGTGAACGTGCCCG

TGCTGGGAAGCTCCACGCTCCTGCAAGGAGGGGACCTCCTCAGAGCCCT

GGACCAGGCCACC,
```

or a nucleic acid sequence that hybridizes to a nucleic acid sequence consisting of SEQ ID NO:82 under stringent hybridization conditions.

In some embodiments, Sonic Headgehog (SHH) comprises the amino acid sequence:

```
                                (SEQ ID NO: 83; NP_000184)
MGEMLLLARCLLLVLVSSLLVCSGLACGPGRGFGKRRHPKKLTPLAYKQ

FIPNVAEKTLGASGRYEGKISRNSERFKELTPNYNPDIIFKDEENTGAD

RLMTQRCKDKLNALAISVMNQWPGVKLRVTEGWDEDGHHSEESLHYEGR

AVDITTSDRDRSKYGMLARLAVEAGFDWVYYESKAHIHCSVKAENSVAA

KSGGCFPGSATVHLEQGGTKLVKDLSPGDRVLAADDQGRLLYSDFLTFL

DRDDGAKKVFYVIETREPRERLLLTAAHLLFVAPHNDSATGEPEASSGS
```

-continued

```
GPPSGGALGPRALFASRVRPGQRVYVVAERDGDRRLLPAAVHSVTLSEE

AAGAYAPLTAQGTILINRVLASCYAVIEEHSWAHRAFAPFRLAHALLAA

LAPARTDRGGDSGGGDRGGGGGRVALTAPGAADAPGAGATAGIHWYSQL

LYQIGTWLLDSEALHPLGMAVKSS,
```

or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:83.

In some embodiments, the nucleic acid sequence encoding SHH comprises the nucleic acid sequence:

```
                                   (SEQ ID NO: 84; NM_000193)
ATGGGCGAGATGCTGCTGCTGGCGAGATGTCTGCTGCTAGTCCTCGTCT

CCTCGCTGCTGGTATGCTCGGGACTGGCGTGCGGACCGGGCAGGGGGTT

CGGGAAGAGGAGGCACCCCAAAAAGCTGACCCCTTTAGCCTACAAGCAG

TTTATCCCCAATGTGGCCGAGAAGACCCTAGGCGCCAGCGGAAGGTATG

AAGGGAAGATCTCCAGAAACTCCGAGCGATTTAAGGAACTCACCCCCAA

TTACAACCCCGACATCATATTTAAGGATGAAGAAAACACCGGAGCGGAC

AGGCTGATGACTCAGAGGTGTAAGGACAAGTTGAACGCTTTGGCCATCT

CGGTGATGAACCAGTGGCCAGGAGTGAAACTGCGGGTGACCGAGGGCTG

GGACGAAGATGGCCACCACTCAGAGGAGTCTCTGCACTACGAGGGCCGC

GCAGTGGACATCACCACGTCTGACCGCGACCGCAGCAAGTACGGCATGC

TGGCCCGCCTGGCGGTGGAGGCCGGCTTCGACTGGGTGTACTACGAGTC

CAAGGCACATATCCACTGCTCGGTGAAAGCAGAGAACTCGGTGGCGGCC

AAATCGGGAGGCTGCTTCCCGGGCTCGGCCACGGTGCACCTGGAGCAGG

GCGGCACCAAGCTGGTGAAGGACCTGAGCCCCGGGGACCGCGTGCTGGC

GGCGGACGACCAGGGCCGGCTGCTCTACAGCGACTTCCTCACTTTCCTG

GACCGCGACGACGGCGCCAAGAAGGTCTTCTACGTGATCGAGACGCGGG

AGCCGCGCGAGCGCCTGCTGCTCACCGCCGCGCACCTGCTCTTTGTGGC

GCCGCACAACGACTCGGCCACCGGGGAGCCCGAGGCGTCCTCGGGCTCG

GGGCCGCCTTCCGGGGGCGCACTGGGGCCTCGGGCGCTGTTCGCCAGCC

GCGTGCGCCCGGGCCAGCGCGTGTACGTGGTGGCCGAGCGTGACGGGGA

CCGCCGGCTCCTGCCCGCCGCTGTGCACAGCGTGACCCTAAGCGAGGAG

GCCGCGGGCGCCTACGCGCCGCTCACGGCCCAGGGCACCATTCTCATCA

ACCGGGTGCTGGCCTCGTGCTACGCGGTCATCGAGGAGCACAGCTGGGC

GCACCGGGCCTTCGCGCCCTTCCGCCTGGCGCACGCGCTCCTGGCTGCA

CTGGCGCCCGCGCGCACGGACCGCGGCGGGGACAGCGGCGGCGGGGACC

GCGGGGGCGGCGGCGGCAGAGTAGCCCTAACCGCTCCAGGTGCTGCCGA

CGCTCCGGGTGCGGGGGCCACCGCGGGCATCCACTGGTACTCGCAGCTG

CTCTACCAAATAGGCACCTGGCTCCTGGACAGCGAGGCCCTGCACCCGC

TGGGCATGGCGGTCAAGTCCAGC,
```

or a nucleic acid sequence that hybridizes to a nucleic acid sequence consisting of SEQ ID NO:84 under stringent hybridization conditions.

In some embodiments, desert hedgehog (DHH) comprises the amino acid sequence:

```
                                   (SEQ ID NO: 85; NP_066382)
MALLTNLLPLCCLALLALPAQSCGPGRGPVGRRRYARKQLVPLLYKQFV

PGVPERTLGASGPAEGRVARGSERFRDLVPNYNPDIIFKDEENSGADRL

MTERCKERVNALAIAVMNMWPGVRLRVTEGWDEDGHHAQDSLHYEGRAL

DITTSDRDRNKYGLLARLAVEAGFDWVYYESRNHVHVSVKADNSLAVRA

GGCFPGNATVRLWSGERKGLRELHRGDWVLAADASGRVVPTPVLLFLDR

DLQRRASFVAVETEWPPRKLLLTPWHLVFAARGPAPAPGDFAPVFARRL

RAGDSVLAPGGDALRPARVARVAREEAVGVFAPLTAHGTLLVNDVLASC

YAVLESHQWAHRAFAPLRLLHALGALLPGGAVQPTGMHWYSRLLYRLAE

ELLG,
```

or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:85.

In some embodiments, the nucleic acid sequence encoding DHH comprises the nucleic acid sequence:

```
                                   (SEQ ID NO: 86; NM_021044)
ATGGCTCTCCTGACCAATCTACTGCCCCTGTGCTGCTTGGCACTTCTGG

CGCTGCCAGCCCAGAGCTGCGGGCCGGGCCGGGGGCCGGTTGGCCGGCG

CCGCTATGCGCGCAAGCAGCTCGTGCCGCTACTCTACAAGCAATTTGTG

CCCGGCGTGCCAGAGCGGACCCTGGGCGCCAGTGGGCCAGCGGAGGGGA

GGGTGGCAAGGGGCTCCGAGCGCTTCCGGGACCTCGTGCCCAACTACAA

CCCCGACATCATCTTCAAGGATGAGGAGAACAGTGGAGCCGACCGCCTG

ATGACCGAGCGTTGTAAGGAGCGGGTGAACGCTTTGGCCATTGCCGTGA

TGAACATGTGGCCCGGAGTGCGCCTACGAGTGACTGAGGGCTGGGACGA

GGACGGCCACCACGCTCAGGATTCACTCCACTACGAAGGCCGTGCTTTG

GACATCACTACGTCTGACCGCGACCGCAACAAGTATGGGTTGCTGGCGC

GCCTCGCAGTGGAAGCCGGCTTCGACTGGGTCTACTACGAGTCCCGCAA

CCACGTCCACGTGTCGGTCAAAGCTGATAACTCACTGGCGGTCCGGGCG

GGCGGCTGCTTTCCGGGAAATGCAACTGTGCGCCTGTGGAGCGGCGAGC

GGAAAGGGCTGCGGGAACTGCACCGCGGAGACTGGGTTTTGGCGGCCGA

TGCGTCAGGCCGGGTGGTGCCCACGCCGGTGCTGCTCTTCCTGGACCGG

GACTTGCAGCGCCGGGCTTCATTTGTGGCTGTGGAGACCGAGTGGCCTC

CACGCAAACTGTTGCTCACGCCCTGGCACCTGGTGTTTGCCGCTCGAGG

GCCGGCGCCCGCGCCAGGCGACTTTGCACCGGTGTTCGCGCGCCGGCTA

CGCGCTGGGGACTCGGTGCTGGCGCCCGGCGGGGATGCGCTTCGGCCAG

CGCGCGTGGCCCGTGTGGCGCGGGAGGAAGCCGTGGGCGTGTTCGCGCC

GCTCACCGCGCACGGGACGCTGCTGGTGAACGATGTCCTGGCCTCTTGC

TACGCGGTTCTGGAGAGTCACCAGTGGGCGCACCGCGCTTTTGCCCCCT

TGAGACTGCTGCACGCGCTAGGGGCGCTGCTCCCCGGCGGGGCCGTCCA
```

-continued

GCCGACTGGCATGCATTGGTACTCTCGGCTCCTCTACCGCTTAGCGGAG

GAGCTACTGGGC, or a nucleic acid sequence that hybridizes to a nucleic acid sequence consisting of SEQ ID NO:86 under stringent hybridization conditions.

In some embodiments, Indian Hedgehog (IHH) comprises the amino acid sequence:

(SEQ ID NO: 87; NP_002172)

MSPARLRPRLHFCLVLLLLLVVPAAWGCGPGRVVGSRRRPPRKLVPLAY

KQFSPNVPEKTLGASGRYEGKIARSSERFKELTPNYNPDIIFKDEENTG

ADRLMTQRCKDRLNSLAISVMNQWPGVKLRVTEGWDEDGHHSEESLHYE

GRAVDITTSDRDRNKYGLLARLAVEAGFDWVYYESKAHVHCSVKSEHSA

AAKTGGCFPAGAQVRLESGARVALSAVRPGDRVLAMGEDGSPTFSDVLI

FLDREPHRLRAFQVIETQDPPRRLALTPAHLLFTADNHTEPAARFRATF

ASHVQPGQYVLVAGVPGLQPARVAAVSTHVALGAYAPLTKHGTLVVEDV

VASCFAAVADHHLAQLAFWPLRLFHSLAWGSWTPGEGVHWYPQLLYRLG

RLLLEEGSFHPLGMSGAGS, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:87.

In some embodiments, the nucleic acid sequence encoding IHH comprises the nucleic acid sequence:

(SEQ ID NO: 88; NM_002181)

ATGTCTCCCGCCCGGCTCCGGCCCCGACTGCACTTCTGCCTGGTCCTGT

TGCTGCTGCTGGTGGTGCCGGCGGCATGGGGCTGCGGGCCGGGTCGGGT

GGTGGGCAGCCGCCGGCGACCGCCACGCAAACTCGTGCCGCTCGCCTAC

AAGCAGTTCAGCCCCAATGTGCCCGAGAAGACCCTGGGCGCCAGCGGAC

GCTATGAAGGCAAGATCGCTCGCAGCTCCGAGCGCTTCAAGGAGCTCAC

CCCCAATTACAATCCAGACATCATCTTCAAGGACGAGGAGAACACAGGC

GCCGACCGCCTCATGACCCAGCGCTGCAAGGACCGCCTGAACTCGCTGG

CTATCTCGGTGATGAACCAGTGGCCCGGTGTGAAGCTGCGGGTGACCGA

GGGCTGGGACGAGGACGGCCACCACTCAGAGGAGTCCCTGCATTATGAG

GGCCGCGCGGTGGACATCACCACATCAGACCGCGACCGCAATAAGTATG

GACTGCTGGCGCGCTTGGCAGTGGAGGCCGGCTTTGACTGGGTGTATTA

CGAGTCAAAGGCCCACGTGCATTGCTCCGTCAAGTCCGAGCACTCGGCC

GCAGCCAAGACAGGCGGCTGCTTCCCTGCCGGAGCCCAGGTACGCCTGG

AGAGTGGGGCGCGTGTGGCCTTGTCAGCCGTGAGGCCGGGAGACCGTGT

GCTGGCCATGGGGGAGGATGGGAGCCCCACCTTCAGCGATGTGCTCATT

TTCCTGGACCGCGAGCCTCACAGGCTGAGAGCCTTCCAGGTCATCGAGA

CTCAGGACCCCCCACGCCGCCTGGCACTCACACCCGCTCACCTGCTCTT

TACGGCTGACAATCACACGGAGCCGGCAGCCCGCTTCCGGGCCACATTT

GCCAGCCACGTGCAGCCTGGCCAGTACGTGCTGGTGGCTGGGGTGCCAG

-continued

GCCTGCAGCCTGCCCGCGTGGCAGCTGTCTCTACACACGTGGCCCTCGG

GGCCTACGCCCCGCTCACAAAGCATGGGACACTGGTGGTGGAGGATGTG

GTGGCATCCTGCTTCGCGGCCGTGGCTGACCACCACCTGGCTCAGTTGG

CCTTCTGGCCCCTGAGACTCTTTCACAGCTTGGCATGGGGCAGCTGGAC

CCCGGGGGAGGGTGTGCATTGGTACCCCCAGCTGCTCTACCGCCTGGGG

CGTCTCCTGCTAGAAGAGGGCAGCTTCCACCCACTGGGCATGTCCGGGG

CAGGGAGC, or a nucleic acid sequence that hybridizes to a nucleic acid sequence consisting of SEQ ID NO:88 under stringent hybridization conditions.

In some embodiments, Brachyury (TBXT) comprises the amino acid sequence:

(SEQ ID NO: 89; NP_003172)

MSSPGTESAGKSLQYRVDHLLSAVENELQAGSEKGDPTERELRVGLEESE

LWLRFKELTNEMIVTKNGRRMFPVLKVNVSGLDPNAMYSFLLDFVAADNH

RWKYVNGEWVPGGKPEPQAPSCVYIHPDSPNFGAHWMKAPVSFSKVKLTN

KLNGGGQIMLNSLHKYEPRIHIVRVGGPQRMITSHCFPETQFIAVTAYQN

EEITALKIKYNPFAKAFLDAKERSDHKEMMEEPGDSQQPGYSQSGGWLLP

GTSTLCPPANPHPQFGGALSLPSTHSCDRYPTLRSHRSSPYPSPYAHRNN

SPTYSDNSPACLSMLQSHDNWSSLGMPAHPSMLPVSHNASPPTSSSQYPS

LWSVSNGAVTPGSQAAAVSNGLGAQFFRGSPAHYTPLTHPVSAPSSSGSP

LYEGAAAATDIVDSQYDAAAQGRLIASWTPVSPPSM, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:89.

In some embodiments, the nucleic acid sequence encoding TBXT comprises the nucleic acid sequence:

(SEQ ID NO: 90; NM_003181)

ATGAGCTCCCCTGGCACCGAGAGCGCGGGAAAGAGCCTGCAGTACCGAGT

GGACCACCTGCTGAGCGCCGTGGAGAATGAGCTGCAGGCGGGCAGCGAGA

AGGGCGACCCCACAGAGCGCGAACTGCGCGTGGGCCTGGAGGAGAGCGAG

CTGTGGCTGCGCTTCAAGGAGCTCACCAATGAGATGATCGTGACCAAGAA

CGGCAGGAGGATGTTTCCGGTGCTGAAGGTGAACGTGTCTGGCCTGGACC

CCAACGCCATGTACTCCTTCCTGCTGGACTTCGTGGCGGCGGACAACCAC

CGCTGGAAGTACGTGAACGGGGAATGGGTGCCGGGGGGCAAGCCGGAGCC

GCAGGCGCCCAGCTGCGTCTACATCCACCCCGACTCGCCCAACTTCGGGG

CCCACTGGATGAAGGCTCCCGTCTCCTTCAGCAAAGTCAAGCTCACCAAC

AAGCTCAACGGAGGGGGCCAGATCATGCTGAACTCCTTGCATAAGTATGA

GCCTCGAATCCACATAGTGAGAGTTGGGGGTCCACAGCGCATGATCACCA

GCCACTGCTTCCCTGAGACCCAGTTCATAGCGGTGACTGCTTATCAGAAC

GAGGAGATCACAGCTCTTAAAATTAAGTACAATCCATTTGCAAAAGCTTT

-continued

CCTTGATGCAAAGGAAAGAAGTGATCACAAAGAGATGATGGAGGAACCCG

GAGACAGCCAGCAACCTGGGTACTCCCAATCAGGGGGGTGGCTTCTTCCT

GGAACCAGCACCCTGTGTCCACCTGCAAATCCTCATCCTCAGTTTGGAGG

TGCCCTCTCCCTCCCCTCCACGCACAGCTGTGACAGGTACCCAACCCTGA

GGAGCCACCGGTCCTCACCCTACCCCAGCCCCTATGCTCATCGGAACAAT

TCTCCAACCTATTCTGACAACTCACCTGCATGTTTATCCATGCTGCAATC

CCATGACAATTGGTCCAGCCTTGGAATGCCTGCCCATCCCAGCATGCTCC

CCGTGAGCCACAATGCCAGCCCACCTACCAGCTCCAGTCAGTACCCCAGC

CTGTGGTCTGTGAGCAACGGCGCCGTCACCCCGGGCTCCCAGGCAGCAGC

CGTGTCCAACGGGCTGGGGGCCCAGTTCTTCCGGGGCTCCCCCGCGCACT

ACACACCCCTCACCCATCCGGTCTCGGCGCCCTCTTCCTCGGGATCCCCA

CTGTACGAAGGGGCGGCCGCGGCCACAGACATCGTGGACAGCCAGTACGA

CGCCGCAGCCCAAGGCCGCCTCATAGCCTCATGGACACCTGTGTCGCCAC

CTTCCATG, or a nucleic acid sequence that hybridizes to a nucleic acid sequence consisting of SEQ ID NO:90 under stringent hybridization conditions.

In some embodiments, T-box brain 1 (TBR1) comprises the amino acid sequence:

(SEQ ID NO: 91; NP_006584)

MQLEHCLSPSIMLSKKFLNVSSSYPHSGGSELVLHDHPIISTTDNLERSS

PLKKITRGMTNQSDTDNFPDSKDSPGDVQRSKLSPVLDGVSELRHSFDGS

AADRYLLSQSSQPQSAATAPSAMFPYPGQHGPAHPAFSIGSPSRYMAHHP

VITNGAYNSLLSNSSPQGYPTAGYPYPQQYGHSYQGAPFYQFSSTQPGLV

PGKAQVYLCNRPLWLKFHRHQTEMIITKQGRRMFPFLSFNISGLDPTAHY

NIFVDVILADPNHWRFQGGKWVPCGKADTNVQGNRVYMHPDSPNTGAHWM

RQEISFGKLKLTNNKGASNNNGQMVVLQSLHKYQPRLHVVEVNEDGTEDT

SQPGRVQTFTFPETQFIAVTAYQNTDITQLKIDHNPFAKGFRDNYDTIYT

GCDMDRLTPSPNDSPRSQIVPGARYAMAGSFLQDQFVSNYAKARFHPGAG

AGPGPGTDRSVPHTNGLLSPQQAEDPGAPSPQRWFVTPANNRLDFAASAY

DTATDFAGNAATLLSYAAAGVKALPLQAAGCTGRPLGYYADPSGWGARSP

PQYCGTKSGSVLPCWPNSAAAAARMAGANPYLGEEAEGLAAERSPLPPGA

AEDAKPKDLSDSSWIETPSSIKSIDSSDSGIYEQAKRRRISPADTPVSES

SSPLKSEVLAQRDCEKNCAKDISGYYGFYSHS, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:91.

In some embodiments, the nucleic acid sequence encoding TBR1 comprises the nucleic acid sequence:

(SEQ ID NO: 92; NM_006593)

ATGCAGCTGGAGCACTGCCTTTCTCCTTCTATCATGCTCTCCAAGAAATT

TCTCAATGTGAGCAGCAGCTACCCACATTCAGGCGGATCCGAGCTTGTCT

-continued

TGCACGATCATCCCATTATCTCGACCACTGACAACCTGGAGAGAAGTTCA

CCTTTGAAAAAAATTACCAGGGGGATGACGAATCAGTCAGATACAGACAA

TTTTCCTGACTCCAAGGACTCACCAGGGGACGTCCAGAGAAGTAAACTCT

CTCCTGTCTTGGACGGGGTCTCTGAGCTTCGTCACAGTTTCGATGGCTCT

GCTGCAGATCGCTACCTCCTCTCTCAGTCCAGCCAGCCACAGTCTGCGGC

CACTGCTCCCAGTGCCATGTTCCCGTACCCCGGCCAGCACGGACCGGCGC

ACCCCGCCTTCTCCATCGGCAGCCCTAGCCGCTACATGGCCCACCACCCG

GTCATCACCAACGGAGCCTACAACAGCCTCCTGTCCAACTCCTCGCCGCA

GGGATACCCCACGGCCGGCTACCCCTACCCACAGCAGTACGGCCACTCCT

ACCAAGGAGCTCCGTTCTACCAGTTCTCCTCCACCCAGCCGGGGCTGGTG

CCCGGCAAAGCACAGGTGTACCTGTGCAACAGGCCCCTTTGGCTGAAATT

TCACCGGCACCAAACGGAGATGATCATCACCAAACAGGGAAGGCGCATGT

TTCCTTTTTTAAGTTTTAACATTTCTGGTCTCGATCCCACGGCTCATTAC

AATATTTTTGTGGATGTGATTTTGGCGGATCCCAATCACTGGAGGTTTCA

AGGAGGCAAATGGGTTCCTTGCGGCAAAGCGGACACCAATGTGCAAGGAA

ATCGGGTCTATATGCATCCGGATTCCCCCAACACTGGGGCTCACTGGATG

CGCCAAGAAATCTCTTTTGGAAAATTAAAACTTACGAACAACAAAGGAGC

TTCAAATAACAATGGGCAGATGGTGGTTTTACAGTCCTTGCACAAGTACC

AGCCCCGCCTGCATGTGGTGGAAGTGAACGAGGACGGCACGGAGGACACT

AGCCAGCCCGGCCGCGTGCAGACGTTCACTTTCCCTGAGACTCAGTTCAT

CGCCGTCACCGCCTACCAGAACACGGATATTACACAACTGAAAATAGATC

ACAACCCTTTTGCAAAAGGATTTCGGGATAATTATGACACGATCTACACC

GGCTGTGACATGGACCGCCTGACCCCCTCGCCCAACGACTCGCCGCGCTC

GCAGATCGTGCCCGGGGCCCGCTACGCCATGGCCGGCTCTTTCCTGCAGG

ACCAGTTCGTGAGCAACTACGCCAAGGCCCGCTTCCACCCGGGCGCGGGC

GCGGGCCCCGGGCCGGGTACGGACCGCAGCGTGCCGCACACCAACGGGCT

GCTGTCGCCGCAGCAGGCCGAGGACCCGGGCGCGCCCTCGCCGCAACGCT

GGTTTGTGACGCCGGCCAACAACCGGCTGGACTTCGCGGCCTCGGCCTAT

GACACGGCCACGGACTTCGCGGGCAACGCGGCCACGCTGCTCTCTTACGC

GGCGGCGGGCGTGAAGGCGCTGCCGCTGCAGGCTGCAGGCTGCACTGGCC

GCCCGCTCGGCTACTACGCCGACCCGTCGGGCTGGGGCGCCCGCAGTCCC

CCGCAGTACTGCGGCACCAAGTCGGGCTCGGTGCTGCCCTGCTGGCCCAA

CAGCGCCGCGGCCGCCGCGCGCATGGCCGGCGCCAATCCCTACCTGGGCG

AGGAGGCCGAGGGCCTGGCCGCCGAGCGCTCGCCGCTGCCGCCCGGCGCC

GCCGAGGACGCCAAGCCCAAGGACCTGTCCGATTCCAGCTGGATCGAGAC

GCCCTCCTCGATCAAGTCCATCGACTCCAGCGACTCGGGGATTTACGAGC

AGGCCAAGCGGAGGCGGATCTCGCCGGCCGACACGCCCGTGTCCGAGAGT

TCGTCCCCGCTCAAGAGCGAGGTGCTGGCCCAGCGGGACTGCGAGAAGAA

CTGCGCCAAGGACATTAGCGGCTACTATGGCTTCTACTCGCACAGC, or a nucleic acid sequence that hybridizes to a nucleic acid sequence consisting of SEQ ID NO:92 under stringent hybridization conditions.

In some embodiments, T-Box 1 (TBX1) comprises the amino acid sequence:

```
(SEQ ID NO: 93; NP_542377)
MHFSTVTRDMEAFTASSLSSLGAAGGFPGAASPGADPYGPREPPPPPRYD
PCAAAAPGAPGPPPPPHAYPFAPAAGAATSAAAEPEGPGASCAAAAKAPV
KKNAKVAGVSVQLEMKALWDEFNQLGTEMIVTKAGRRMFPTFQVKLFGMD
PMADYMLLMDFVPVDDKRYRYAFHSSSWLVAGKADPATPGRVHYHPDSPA
KGAQWMKQIVSFDKLKLTNNLLDDNGHIILNSMHRYQPRFHVVYVDPRKD
SEKYAEENFKTFVFEETRFTAVTAYQNHRITQLKIASNPFAKGFRDCDPE
DWPRNHRPGALPLMSAFARSRNPVASPTQPSGTEKDAAEARREFQRDAGG
PAVLGDPAHPPQLLARVLSPSLPGAGGAGGLVPLPGAPGGRPSPPNPELR
LEAPGASEPLHHHPYKYPAAAYDHYLGAKSRPAPYPLPGLRGHGYHPHAN
PHHHHHPVSPAAAAAAAAAAAAAAANMYSSAGAAPPGSYDYCPR,
```

or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:93.

In some embodiments, the nucleic acid sequence encoding TBX1 comprises the nucleic acid sequence:

```
(SEQ ID NO: 94; NM_080647)
ATGCACTTCAGCACCGTCACCAGGGACATGGAAGCCTTCACGGCCAGCAG
CCTGAGCAGCCTGGGGGCCGCGGGGGGCTTCCCGGGCGCCGCGTCGCCCG
GCGCCGACCCGTACGGCCCGCGCGAGCCCCCGCCGCCGCCGCGCTACGAC
CCGTGCGCCGCCGCCGCCCCCGGCGCCCCGGGTCCGCCGCCGCCGCCGCA
CGCCTACCCGTTTGCGCCGGCCGCCGGGGCCGCCACCAGCGCCGCCGCCG
AGCCCGAGGGCCCCGGGGCCAGCTGCGCGGCCGCAGCCAAGGCGCCGGTG
AAGAAGAACGCGAAGGTGGCCGGTGTGAGCGTGCAGCTAGAGATGAAGGC
GCTGTGGGACGAGTTCAACCAGCTGGGCACCGAGATGATCGTCACCAAGG
CCGGCAGGCGGATGTTTCCCACCTTCCAAGTGAAGCTCTTCGGCATGGAT
CCCATGGCCGACTATATGCTGCTCATGGACTTCGTGCCGGTGGACGATAA
GCGCTACCGGTACGCCTTCCACAGCTCCTCCTGGCTGGTGGCGGGGAAGG
CCGACCCTGCCACGCCAGGCCGCGTGCACTACCACCCGGACTCGCCTGCC
AAGGGCGCGCAGTGGATGAAGCAAATCGTGTCCTTCGACAAGCTCAAGCT
GACCAACAACTTACTGGACGACAACGGCCACATTATTCTGAATTCCATGC
ACAGATACCAGCCCCGCTTCCACGTGGTCTATGTGGACCCACGCAAAGAT
AGCGAGAAATATGCCGAGGAGAACTTCAAAACCTTTGTGTTCGAGGAGAC
ACGATTCACCGCGGTCACTGCCTACCAGAACCATCGGATCACGCAGCTCA
AGATTGCCAGCAATCCCTTCGCGAAAGGCTTCCGGGACTGTGACCCTGAG
GACTGGCCCCGGAACCACCGGCCCGGCGCACTGCCGCTCATGAGCGCCTT
CGCGCGCTCGCGGAACCCCGTGGCTTCCCCGACGCAGCCCAGCGGCACGG
AGAAAGACGCGGCTGAGGCCCGGCGAGAATTCCAGCGCGACGCGGGCGGG
CCAGCGGTGCTCGGGGACCCGGCGCATCCTCCGCAGCTGCTGGCCCGGGT
```

-continued

```
GCTAAGCCCCTCGCTGCCCGGGGCCGGCGGCGCCGGCGGCTTAGTCCCGC
TGCCCGGCGCGCCCGGAGGCCGGCCCAGTCCCCCGAACCCCGAGCTGCGC
CTGGAGGCGCCCGGCGCATCGGAGCCGCTGCACCACCACCCCTACAAATA
TCCGGCCGCCGCCTACGACCACTATCTCGGGGCCAAGAGCCGGCCGGCGC
CCTACCCGCTGCCCGGCCTGCGTGGCCACGGCTACCACCCGCACGCGCAT
CCGCACCACCACCACCACCCCGTGAGTCCAGCCGCCGCGGCCGCCGCCGC
CGCTGCCGCAGCTGCCGCGGCCGCCAACATGTACTCGTCGGCCGGAGCCG
CGCCGCCCGGCTCCTACGACTATTGCCCCAGA,
```

or a nucleic acid sequence that hybridizes to a nucleic acid sequence consisting of SEQ ID NO:94 under stringent hybridization conditions.

In some embodiments, T-box 2 (TBX2) comprises the amino acid sequence:

```
(SEQ ID NO: 95; NP_005985)
MREPALAASAMAYHPFHAPRPADFPMSAFLAAAQPSFFPALALPPGALAK
PLPDPGLAGAAAAAAAAAAAAAEAGLHVSALGPHPPAAHLRSLKSLEPEDE
VEDDPKVTLEAKELWDQFHKLGTEMVITKSGRRMFPPFKVRVSGLDKKAK
YILLMDIVAADDCRYKFHNSRWMVAGKADPEMPKRMYIHPDSPATGEQWM
AKPVAFHKLKLTNNISDKHGFTILNSMHKYQPRFHIVRANDILKLPYSTF
RTYVFPETDFIAVTAYQNDKITQLKIDNNPFAKGFRDTGNGRREKRKQLT
LPSLRLYEEHCKPERDGAESDASSCDPPPAREPPTSPGAAPSPLRLHRAR
AEEKSCAADSDPEPERLSEERAGAPLGRSPAPDSASPTRLTEPERARERR
SPERGKEPAESGGDGPFGLRSLEKERAEARRKDEGRKEAAEGKEQGLAPL
VVQTDSASPLGAGHLPGLAFSSHLHGQQFFGPLGAGQPLFLHPGQFTMGP
GAFSAMGMGHLLASVAGGGNGGGGGPGTAAGLDAGGLGPAASAASTAAPF
PFHLSQHMLASQGIPMPTFGGLFPYPYTYMAAAAAAASALPATSAAAAAA
AAAGSLSRSPFLGSARPRLRFSPYQIPVTIPPSTSLLTTGLASEGSKAAG
GNSREPSPLPELALRKVGAPSRGALSPSGSAKEAANELQSIQRLVSGLES
QRALSPGRESPK,
```

or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:95.

In some embodiments, the nucleic acid sequence encoding TBX2 comprises the nucleic acid sequence:

```
(SEQ ID NO: 96; NM_005994)
ATGAGAGAGCCGGCGCTGGCGGCCAGCGCCATGGCTTACCACCCGTTCCA
CGCGCCACGGCCCGCCGACTTCCCCATGTCCGCCTTTCTGGCGGCGGCGC
AGCCCTCCTTCTTCCCGGCACTCGCGCTGCCGCCCGGCGCGCTGGCCAAG
CCGCTGCCCGACCCGGGCCTGGCGGGGGCGGCGGCCGCGGCGGCGGCGGC
GGCAGCAGCGGCCGAGGCGGGGCTGCACGTCTCGGCACTGGGCCCGCACC
CGCCCGCCGCGCATCTGCGCTCCCTCAAGAGCCTGGAGCCCGAGGACGAG
GTGGAGGACGACCCCAAGGTGACGCTGGAGGCCAAGGAGCTGTGGGACCA
```

-continued

```
GTTCCACAAGCTAGGCACGGAGATGGTCATCACCAAGTCCGGGAGGCGGA
TGTTCCCCCCCTTCAAGGTGCGAGTCAGCGGCCTGGACAAGAAGGCCAAG
TATATCCTGCTGATGGACATTGTAGCCGCTGACGATTGCCGCTATAAGTT
CCACAACTCGCGCTGGATGGTGGCGGGCAAGGCCGACCCTGAGATGCCCA
AACGCATGTACATCCACCCAGACAGCCCAGCCACGGGGGAGCAGTGGATG
GCTAAGCCTGTGGCCTTCCACAAGCTGAAGCTGACCAACAACATCTCTGA
CAAGCACGGCTTCACCATCCTAAACTCCATGCACAAGTACCAGCCGCGCT
TCCACATAGTGCGAGCCAACGACATCCTGAAGCTGCCTTACAGCACCTTC
CGCACCTACGTGTTCCCGGAGACCGACTTCATCGCCGTCACTGCCTACCA
GAATGACAAGATCACACAGCTGAAGATCGACAACAACCCGTTTGCCAAGG
GCTTCCGGGACACCGGGAACGGCCGGCGGGAGAAAAGGAAGCAGCTGACG
CTGCCGTCTCTACGCTTGTACGAGGAGCACTGCAAACCCGAGCGCGATGG
CGCGGAGTCAGACGCCTCGTCGTGCGACCCTCCCCCGCGCGGGAACCAC
CCACCTCCCCGGGCGCAGCGCCCAGTCCGCTGCGCCTGCACCGGGCCCGA
GCTGAGGAGAAGTCGTGCGCCGCGGACAGCGACCCGGAGCCTGAGCGGTT
GAGCGAGGAGCGTGCGGGGGCGCCGCTAGGCCGCAGCCCGGCTCCAGACA
GCGCCAGCCCCACTCGCTTGACCGAACCCGAGCGCGCCCGGGAGCGGCGT
AGTCCCGAGAGGGGCAAGGAGCCGGCCGAGAGCGGCGGGGACGGCCCGTT
CGGCCTGAGGAGCCTGGAGAAGGAGCGCGCCGAAGCTCGGAGGAAGGACG
AGGGGCGCAAGGAGGCGGCCGAGGGCAAGGAGCAGGGCCTGGCGCCGCTG
GTGGTGCAGACAGACAGTGCGTCCCCCCTGGGCGCCGGACACCTGCCCGG
CCTGGCCTTTTCCAGCCACTTGCACGGGCAGCAGTTCTTTGGGCCGCTGG
GAGCCGGCCAGCCGCTCTTCCTGCACCCTGGACAGTTCACCATGGGCCCT
GGCGCCTTCTCCGCCATGGGCATGGGTCACCTACTGGCCTCGGTGGCAGG
CGGCGGCAACGGCGGAGGTGGCGGGCCTGGGACCGCCGCGGGGCTGGACG
CAGGCGGGCTGGGTCCCGCGGCCAGCGCAGCAAGCACCGCCGCGCCCTTC
CCGTTCCACCTCTCCCAGCACATGCTGGCATCTCAGGGAATTCCAATGCC
CACTTTCGGAGGCCTCTTCCCCTACCCCTACACCTACATGGCAGCAGCAG
CCGCAGCCGCCTCGGCTTTGCCCGCCACTAGTGCTGCAGCTGCCGCCGCC
GCAGCCGCCGGCTCCCTCTCCCGGAGCCCCTTCCTGGGCAGTGCCCGGCC
CCGACTGCGTTTCAGCCCCTATCAGATCCCGGTCACCATCCCGCCTAGCA
CTAGCCTCCTCACCACCGGGCTGGCCTCTGAGGGCTCCAAGGCCGCTGGT
GGAAACAGCCGGGAGCCTAGCCCCCTGCCCGAGCTGGCTCTCCGCAAAGT
AGGGGCCCCATCCCGCGGTGCCCTGTCGCCCAGTGGCTCGGCCAAGGAGG
CGGCCAATGAACTGCAGAGCATCCAGAGACTGGTGAGTGGGCTGGAGAGC
CAGCGAGCCCTCTCCCCAGGCCGGGAGTCGCCCAAG,
```

or a nucleic acid sequence that hybridizes to a nucleic acid sequence consisting of SEQ ID NO:96 under stringent hybridization conditions.

In some embodiments, T-box 3 (TBX3) comprises the amino acid sequence:

```
                              (SEQ ID NO: 97; NP_057653)
MSLSMRDPVIPGTSMAYHPFLPHRAPDFAMSAVLGHQPPFFPALTLPPNG
AAALSLPGALAKPIMDQLVGAAETGIPFSSLGPQAHLRPLKTMEPEEEVE
DDPKVHLEAKELWDQFHKRGTEMVITKSGRRMFPPFKVRCSGLDKKAKYI
LLMDIIAADDCRYKFHNSRWMVAGKADPEMPKRMYIHPDSPATGEQWMSK
VVTFHKLKLTNNISDKHGFTLAFPSDHATWQGNYSFGTQTILNSMHKYQP
RFHIVRANDILKLPYSTFRTYLFPETEFIAVTAYQNDKITQLKIDNNPFA
KGFRDTGNGRREKRKQLTLQSMRVFDERHKKENGTSDESSSEQAAFNCFA
QASSPAASTVGTSNLKDLCPSEGESDAEAESKEEHGPEACDAAKISTTTS
EEPCRDKGSPAVKAHLFAAERPRDSGRLDKASPDSRHSPATISSSTRGLG
AEERRSPVREGTAPAKVEEARALPGKEAFAPLTVQTDAAAAHLAQGPLPG
LGFAPGLAGQQFFNGHPLFLHPSQFAMGGAFSSMAAAGMGPLLATVSGAS
TGVSGLDSTAMASAAAAQGLSGASAATLPFHLQQHVLASQGLAMSPFGSL
FPYPYTYMAAAAAASSAAASSSVHRHPFLNLNTMRPRLRYSPYSIPVPVP
DGSSLLTTALPSMAAAAGPLDGKVAALAASPASVAVDSGSELNSRSSTLS
SSSMSLSPKLCAEKEAATSELQSIQRLVSGLEAKPDRSRSASP,
```

or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:97.

In some embodiments, the nucleic acid sequence encoding TBX3 comprises the nucleic acid sequence

```
                              (SEQ ID NO: 98; NM_016569)
ATGAGCCTCTCCATGAGAGATCCGGTCATTCCTGGGACAAGCATGGCCTA
CCATCCGTTCCTACCTCACCGGGCGCCGGACTTCGCCATGAGCGCGGTGC
TGGGTCACCAGCCGCCGTTCTTCCCCGCGCTGACGCTGCCTCCCAACGGC
GCGGCGGCGCTCTCGCTGCCGGGCGCCCTGGCCAAGCCGATCATGGATCA
ATTGGTGGGGGCGGCCGAGACCGGCATCCCGTTCTCCTCCCTGGGGCCCC
AGGCGCATCTGAGGCCTTTGAAGACCATGGAGCCCGAAGAAGAGGTGGAG
GACGACCCCAAGGTGCACCTGGAGGCTAAAGAACTTTGGGATCAGTTTCA
CAAGCGGGGCACCGAGATGGTCATTACCAAGTCGGGAAGGCGAATGTTTC
CTCCATTTAAAGTGAGATGTTCTGGGCTGGATAAAAAAGCCAAATACATT
TTATTGATGGACATTATAGCTGCTGATGACTGTCGTTATAAATTTCACAA
TTCTCGGTGGATGGTGGCTGGTAAGGCCGACCCCGAAATGCCAAAGAGGA
TGTACATTCACCCGGACAGCCCCGCTACTGGGGAACAGTGGATGTCCAAA
GTCGTCACTTTCCACAAACTGAAACTCACCAACAACATTTCAGACAAACA
TGGATTTACTTTGGCCTTCCCAAGTGATCACGCTACGTGGCAGGGGAATT
ATAGTTTTGGTACTCAGACTATATTGAACTCCATGCACAAATACCAGCCC
CGGTTCCACATTGTAAGAGCCAATGACATCTTGAAACTCCCTTATAGTAC
ATTTCGGACATACTTGTTCCCCGAAACTGAATTCATCGCTGTGACTGCAT
```

-continued

ACCAGAATGATAAGATAACCCAGTTAAAAATAGACAACAACCCTTTTGCA
AAAGGTTTCCGGGACACTGGAAATGGCCGAAGAGAAAAAAGAAAACAGCT
CACCCTGCAGTCCATGAGGGTGTTTGATGAAAGACACAAAAAGGAGAATG
GGACCTCTGATGAGTCCTCCAGTGAACAAGCAGCTTTCAACTGCTTCGCC
CAGGCTTCTTCTCCAGCCGCCTCCACTGTAGGGACATCGAACCTCAAAGA
TTTATGTCCCAGCGAGGGTGAGAGCGACGCCGAGGCCGAGAGCAAAGAGG
AGCATGGCCCCGAGGCCTGCGACGCGGCCAAGATCTCCACCACCACGTCG
GAGGAGCCCTGCCGTGACAAGGGCAGCCCCGCGGTCAAGGCTCACCTTTT
CGCTGCTGAGCGGCCCCGGGACAGCGGGCGGCTGGACAAAGCGTCGCCCG
ACTCACGCCATAGCCCCGCCACCATCTCGTCCAGCACTCGCGGCCTGGGC
GCGGAGGAGCGCAGGAGCCCGGTTCGCGAGGGCACAGCGCCGGCCAAGGT
GGAAGAGGCGCGCGCGCTCCCGGGCAAGGAGGCCTTCGCGCCGCTCACGG
TGCAGACGGACGCGGCCGCCGCGCACCTGGCCCAGGGCCCCCTGCCTGGC
CTCGGCTTCGCCCCGGGCCTGGCGGGCCAACAGTTCTTCAACGGGCACCC
GCTCTTCCTGCACCCCAGCCAGTTTGCCATGGGGGGCGCCTTCTCCAGCA
TGGCGGCCGCTGGCATGGGTCCCCTCCTGGCCACGGTTTCTGGGGCCTCC
ACCGGTGTCTCGGGCCTGGATTCCACGGCCATGGCCTCTGCCGCTGCGGC
GCAGGGACTGTCCGGGGCGTCCGCGGCCACCCTGCCCTTCCACCTCCAGC
AGCACGTCCTGGCCTCTCAGGGCCTGGCCATGTCCCCTTTCGGAAGCCTG
TTCCCTTACCCCTACACGTACATGGCCGCAGCGGCGGCCGCCTCCTCTGC
GGCAGCCTCCAGCTCGGTGCACCGCCACCCCTTCCTCAATCTGAACACCA
TGCGCCCGCGGCTGCGCTACAGCCCCTACTCCATCCCGGTGCCGGTCCCG
GACGGCAGCAGTCTGCTCACCACCGCCCTGCCCTCCATGGCGGCGGCCGC
GGGGCCCCTGGACGGCAAAGTCGCCGCCCTGGCCGCCAGCCCGGCCTCGG
TGGCAGTGGACTCGGGCTCTGAACTCAACAGCCGCTCCTCCACGCTCTCC
TCCAGCTCCATGTCCTTGTCGCCCAAACTCTGCGCGGAGAAAGAGGCGGC
CACCAGCGAACTGCAGAGCATCCAGCGGTTGGTTAGCGGCTTGGAAGCCA
AGCCGGACAGGTCCCGCAGCGCGTCCCCG, or a nucleic acid sequence that hybridizes to a nucleic acid sequence consisting of SEQ ID NO:98 under stringent hybridization conditions.

In some embodiments, T-box 4 (TBX4) comprises the amino acid sequence:

(SEQ ID NO: 99; NP_060958)

MLQDKGLSESEEAFRAPGPALGEASAANAPEPALAAPGLSGAALGSPPGP
GADVVAAAAAEQTIENIKVGLHEKELWKKFHEAGTEMIITKAGRRMFPSY
KVKVTGMNPKTKYILLIDIVPADDHRYKFCDNKWMVAGKAEPAMPGRLYV
HPDSPATGAHWMRQLVSFQKLKLTNNHLDPFGHIILNSMHKYQPRLHIVK
ADENNAFGSKNTAFCTHVFPETSFISVTSYQNHKITQLKIENNPFAKGFR
GSDDSDLRVARLQSKEYPVISKSIMRQRLISPQLSATPDVGPLLGTHQAL
QHYQHENGAHSQLAEPQDLPLSTFPTQRDSSLFYHCLKRRDGTRHLDLPC
KRSYLEAPSSVGEDHYFRSPPPYDQQMLSPSYCSEVTPREACMYSGSGPE
IAGVSGVDDLPPPPLSCNMWTSVSPYTSYSVQTMETVPYQPFPTHFTATT
MMPRLPTLSAQSSQPPGNAHFSVYNQLSQSQVRERGPSASFPRERGLPQG
CERKPPSPHLNAANEFLYSQTFSLSRESSLQYHSGMGTVENWTDG, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:99.

In some embodiments, the nucleic acid sequence encoding TBX4 comprises the nucleic acid sequence:

(SEQ ID NO: 100; NM_018488)

ATGCTGCAGGATAAGGGCCTGTCCGAGAGCGAGGAGGCCTTCCGGGCCCC
GGGCCCAGCGCTCGGAGAGGCCAGCGCAGCCAACGCCCCCGAGCCCGCGC
TGGCAGCGCCGGGCCTCAGCGGAGCCGCGCTAGGCAGCCCCCCGGGACCC
GGGGCCGACGTCGTCGCCGCCGCCGCCGCGGAGCAGACCATCGAGAACAT
CAAGGTGGGGCTGCATGAGAAGGAGCTCTGGAAGAAGTTCCACGAGGCGG
GCACCGAGATGATCATCACTAAGGCTGGCAGGAGGATGTTCCCCAGCTAC
AAGGTAAAAGTCACAGGCATGAACCCCAAGACCAAGTATATCCTGCTGAT
TGACATTGTCCCTGCCGATGACCATCGCTACAAGTTCTGTGACAACAAAT
GGATGGTGGCAGGGAAGGCTGAGCCAGCCATGCCAGGAAGGCTGTATGTC
CACCCGGATTCTCCTGCCACAGGAGCCCACTGGATGCGGCAGCTGGTCTC
CTTCCAGAAGCTGAAGCTGACAAACAACCACCTGGACCCCTTTGGCCATA
TCATCCTCAACTCTATGCACAAGTACCAGCCGCGGCTCCACATCGTTAAG
GCTGATGAGAACAATGCTTTCGGCTCCAAAAACACTGCTTTCTGCACCCA
CGTGTTCCCAGAGACCTCCTTCATCTCTGTGACCTCCTACCAGAATCACA
AGATCACCCAGCTGAAAATTGAGAACAACCCTTTTGCCAAGGGATTCCGG
GGCAGTGATGACAGTGACCTGCGTGTGGCCCGACTGCAGAGCAAAGAATA
CCCCGTGATTTCCAAAAGCATCATGAGGCAGAGGCTCATCTCCCCCCAGC
TCTCAGCCACACCGGACGTGGGCCCCCTGCTCGGCACCCACCAGGCACTC
CAGCACTACCAGCACGAGAACGGGGCACACTCACAGCTCGCGGAGCCGCA
GGACCTGCCCCTCAGCACCTTTCCCACCCAGAGGGACTCAAGCCTCTTCT
ATCACTGCCTGAAAAGACGAGACGGTACCCGCCACCTGGACTTACCTTGC
AAGCGATCCTATCTGGAAGCCCCCTCTTCGGTGGGGGAGGATCACTATTT
CCGTTCCCCCCCTCCCTACGACCAGCAAATGCTGAGCCCCTCCTACTGCA
GTGAGGTGACCCCCAGAGAAGCATGTATGTACTCAGGTTCAGGGCCCGAG
ATTGCCGGGGTGTCTGGGGTGGACGACCTGCCCCCACCTCCGCTGAGCTG
TAACATGTGGACTTCAGTGTCGCCGTACACCAGCTATAGCGTGCAGACGA
TGGAGACTGTGCCGTACCAGCCCTTCCCCACGCACTTCACCGCCACCACC
ATGATGCCGCGGCTGCCCACCCTCTCCGCTCAGAGCTCCCAGCCACCAGG
AAATGCCCACTTTAGTGTCTACAATCAGCTCTCCCAGTCTCAGGTCCGAG
AGCGGGGGCCCAGCGCCTCATTCCCAAGAGAGCGCGGCCTCCCCCAAGGG
TGTGAGAGGAAGCCACCCTCGCCACATCTAAATGCTGCCAATGAGTTTCT

-continued

```
CTACTCTCAAACCTTCTCCTTGTCCCGAGAATCTTCCTTACAGTACCATT

CAGGAATGGGGACTGTGGAGAACTGGACTGACGGA,
```

or a nucleic acid sequence that hybridizes to a nucleic acid sequence consisting of SEQ ID NO:100 under stringent hybridization conditions.

In some embodiments, T-box 5 (TBX5) comprises the amino acid sequence:

```
                                (SEQ ID NO: 101; NP_000183)
MADADEGFGLAHTPLEPDAKDLPCDSKPESALGAPSKSPSSPQAAFTQQ

GMEGIKVFLHERELWLKFHEVGTEMIITKAGRRMFPSYKVKVTGLNPKT

KYILLMDIVPADDHRYKFADNKWSVTGKAEPAMPGRLYVHPDSPATGAH

WMRQLVSFQKLKLTNNHLDPFGHIILNSMHKYQPRLHIVKADENNGFGS

KNTAFCTHVFPETAFIAVTSYQNHKITQLKIENNPFAKGFRGSDDMELH

RMSRMQSKEYPVVPRSTVRQKVASNHSPFSSESRALSTSSNLGSQYQCE

NGVSGPSQDLLPPPNPYPLPQEHSQIYHCTKRKEEECSTTDHPYKKPYM

ETSPSEEDSFYRSSYPQQQGLGASYRTESAQRQACMYASSAPPSEPVPS

LEDISCNTWPSMPSYSSCTVTTVQPMDRLPYQHFSAHFTSGPLVPRLAG

MANHGSPQLGEGMFQHQTSVAHQPVVRQCGPQTGLQSPGTLQPPEFLYS

HGVPRTLSPHQYHSVHGVGMVPEWSDNS,
```

or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:101.

In some embodiments, the nucleic acid sequence encoding TBX5 comprises the nucleic acid sequence:

```
                                (SEQ ID NO: 102; NM_000192)
ATGGCCGACGCAGACGAGGGCTTTGGCCTGGCGCACACGCCTCTGGAGC

CTGACGCAAAAGACCTGCCCTGCGATTCGAAACCCGAGAGCGCGCTCGG

GGCCCCCAGCAAGTCCCCGTCGTCCCCGCAGGCCGCCTTCACCCAGCAG

GGCATGGAGGGAATCAAAGTGTTTCTCCATGAAAGAGAACTGTGGCTAA

AATTCCACGAAGTGGGCACGGAAATGATCATAACCAAGGCTGGAAGGCG

GATGTTTCCCAGTTACAAAGTGAAGGTGACGGGCCTTAATCCCAAAACG

AAGTACATTCTTCTCATGGACATTGTACCTGCCGACGATCACAGATACA

AATTCGCAGATAATAAATGGTCTGTGACGGGCAAAGCTGAGCCCGCCAT

GCCTGGCCGCCTGTACGTGCACCCAGACTCCCCCGCCACCGGGGCGCAT

TGGATGAGGCAGCTCGTCTCCTTCCAGAAACTCAAGCTCACCAACAACC

ACCTGGACCCATTTGGGCATATTATTCTAAATTCCATGCACAAATACCA

GCCTAGATTACACATCGTGAAAGCGGATGAAAATAATGGATTTGGCTCA

AAAAATACAGCGTTCTGCACTCACGTCTTTCCTGAGACTGCGTTTATAG

CAGTGACTTCTTACCAGAACCACAAGATCACGCAATTAAAGATTGAGAA

TAATCCCTTTGCCAAAGGATTTCGGGGCAGTGATGACATGGAGCTGCAC

AGAATGTCAAGAATGCAAAGTAAAGAATATCCCGTGGTCCCCAGGAGCA

CCGTGAGGCAAAAAGTGGCCTCCAACCACAGTCCTTTCAGCAGCGAGTC
```

-continued

```
TCGAGCTCTCTCCACCTCATCCAATTTGGGGTCCCAATACCAGTGTGAG

AATGGTGTTTCCGGCCCCTCCCAGGACCTCCTGCCTCCACCCAACCCAT

ACCCACTGCCCCAGGAGCATAGCCAAATTTACCATTGTACCAAGAGGAA

AGAGGAAGAATGTTCCACCACAGACCATCCCTATAAGAAGCCCTACATG

GAGACATCACCCAGTGAAGAAGATTCCTTCTACCGCTCTAGCTATCCAC

AGCAGCAGGGCCTGGGTGCCTCCTACAGGACAGAGTCGGCACAGCGGCA

AGCTTGCATGTATGCCAGCTCTGCGCCCCCCAGCGAGCCTGTGCCCAGC

CTAGAGGACATCAGCTGCAACACGTGGCCAAGCATGCCTTCCTACAGCA

GCTGCACCGTCACCACCGTGCAGCCCATGGACAGGCTACCCTACCAGCA

CTTCTCCGCTCACTTCACCTCGGGGCCCCTGGTCCCTCGGCTGGCTGGC

ATGGCCAACCATGGCTCCCCACAGCTGGGAGAGGGAATGTTCCAGCACC

AGACCTCCGTGGCCCACCAGCCTGTGGTCAGGCAGTGTGGGCCTCAGAC

TGGCCTGCAGTCCCCTGGCACCCTTCAGCCCCCTGAGTTCCTCTACTCT

CATGGCGTGCCAAGGACTCTATCCCCTCATCAGTACCACTCTGTGCACG

GAGTTGGCATGGTGCCAGAGTGGAGCGACAATAGC,
```

or a nucleic acid sequence that hybridizes to a nucleic acid sequence consisting of SEQ ID NO:102 under stringent hybridization conditions.

In some embodiments, T-box 6 (TBX6) comprises the amino acid sequence:

```
                                (SEQ ID NO: 103; NP_542936)
MYHPRELYPSLGAGYRLGPAQPGADSSFPPALAEGYRYPELDTPKLDCF

LSGMEAAPRTLAAHPPLPLLPPAMGTEPAPSAPEALHSLPGVSLSLENR

ELWKEFSSVGTEMIITKAGRRMFPACRVSVTGLDPEARYLFLLDVIPVD

GARYRWQGRRWEPSGKAEPRLPDRVYIHPDSPATGAHWMRQPVSFHRVK

LTNSTLDPHGHLILHSMHKYQPRIHLVRAAQLCSQHWGGMASFRFPETT

FISVTAYQNPQITQLKIAANPFAKGFRENGRNCKRWELFIHLFMHSTNV

Y,
```

or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:103.

In some embodiments, the nucleic acid sequence encoding TBX6 comprises the nucleic acid sequence:

```
                                (SEQ ID NO: 104; NM_080758)
ATGTACCATCCACGAGAATTGTACCCGTCCCTGGGGGCCGGCTACCGCC

TGGGGCCCGCCCAACCTGGGGCCGACTCCAGCTTCCCACCCGCCCTAGC

GGAGGGCTACCGCTACCCCGAACTGGACACCCCTAAACTGGATTGCTTC

CTCTCCGGGATGGAGGCTGCTCCCCGCACCCTGGCCGCGCACCCACCTC

TGCCCCTTCTGCCCCCTGCCATGGGCACTGAGCCGGCCCCATCAGCTCC

AGAGGCCCTCCATTCCCTCCCGGGGGTCAGCCTGAGCCTGGAGAACCGG

GAGCTATGGAAGGAGTTCAGCTCTGTGGGAACAGAAATGATCATCACCA
```

-continued

AAGCTGGGAGGCGCATGTTCCCTGCCTGCCGAGTGTCAGTCACTGGCCT

GGACCCCGAGGCCCGCTACTTGTTTCTTCTGGATGTGATTCCGGTGGAT

GGGGCTCGCTACCGCTGGCAGGGCCGGCGCTGGGAGCCCAGCGGCAAGG

CAGAGCCCCGCCTGCCTGACCGTGTCTACATTCACCCCGACTCTCCTGC

CACTGGTGCACATTGGATGCGGCAGCCTGTGTCTTTCCATCGTGTCAAG

CTCACCAACAGCACGCTGGACCCCCACGGCCACCTGATCCTGCACTCCA

TGCACAAGTACCAACCCCGCATACACCTAGTTCGGGCAGCCCAGCTCTG

CAGCCAGCACTGGGGGGCATGGCCTCCTTCCGCTTCCCCGAGACCACA

TTCATCTCCGTGACAGCCTACCAGAACCCACAGATCACACAACTGAAGA

TTGCAGCCAATCCCTTTGCCAAAGGCTTCCGGGAGAACGGCAGAAACTG

TAAGAGGTGGGAGTTGTTCATTCATTTGTTCATGCATTCAACAAATGTT

TAT, or a nucleic acid sequence that hybridizes to a nucleic acid sequence consisting of SEQ ID NO:104 under stringent hybridization conditions.

In some embodiments, T-box 10 (TBX10) comprises the amino acid sequence:

(SEQ ID NO: 105; NP_005986)

MAAFLSAGLGILAPSETYPLPTTSSGWEPRLGSPFPSGPCTSSTGAQAV

AEPTGQGPKNPRVSRVTVQLEMKPLWEEFNQLGTEMIVTKAGRRMFPPF

QVKILGMDSLADYALLMDFIPLDDKRYRYAFHSSAWLVAGKADPATPGR

VHFHPDSPAKGAQWMRQIVSFDKLKLTNNLLDDNGHIILNSMHRYQPRF

HVVFVDPRKDSERYAQENFKSFIFTETQFTAVTAYQNHRITQLKIASNP

FAKGFRESDLDSWPVAPRPLLSVPARSHSSLSPCVLKGATDREKDPNKA

SASTSKTPAWLHHQLLPPPEVLLAPATYRPVTYQSLYSGAPSHLGIPRT

RPAPYPLPNIRADRDQGGLPLPAGLGLLSPTVVCLGPGQDSQ, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:105.

In some embodiments, the nucleic acid sequence encoding TBX10 comprises the nucleic acid sequence:

(SEQ ID NO: 106; NM_005995)

ATGGCAGCCTTCCTATCTGCTGGCCTCGGCATACTTGCACCCTCAGAGA

CCTACCCCCTACCTACAACCAGCTCTGGCTGGGAGCCCCGGCTGGGGTC

ACCATTCCCATCAGGCCCTTGCACCAGCTCTACTGGGGCCCAAGCTGTG

GCCGAGCCCACTGGGCAGGGCCCCAAGAACCCACGTGTGTCCAGAGTGA

CAGTTCAGCTGGAGATGAAGCCTCTGTGGGAGGAATTCAACCAGCTGGG

CACTGAGATGATCGTCACCAAGGCAGGCAGGAGGATGTTCCCCCCCTTC

CAGGTGAAGATCCTGGGCATGGACTCCCTGGCCGACTACGCCCTGCTCA

TGGACTTCATCCCCCTGGACGACAAGAGATACAGGTATGCCTTCCACAG

CTCGGCCTGGCTGGTGGCGGGCAAGGCAGACCCAGCCACACCTGGCCGC

GTGCACTTCCACCCCGACTCGCCAGCCAAGGGTGCCCAGTGGATGCGCC

-continued

AGATTGTGTCCTTTGACAAGCTCAAGCTGACCAACAACCTGCTGGATGA

CAATGGCCACATCATTCTCAACTCTATGCACCGCTACCAGCCCCGTTTC

CACGTGGTCTTCGTGGACCCACGCAAGGACAGTGAGCGCTATGCCCAGG

AGAACTTCAAGTCCTTCATCTTCACAGAGACCCAGTTCACAGCAGTGAC

AGCCTATCAGAACCACAGGATCACCCAGCTGAAAATCGCCAGCAACCCT

TTTGCCAAAGGCTTTAGAGAGAGTGACCTGGACTCCTGGCCTGTGGCCC

CACGGCCCCTGCTCAGTGTCCCAGCCCGGAGTCACAGCAGCCTCAGTCC

CTGTGTGCTGAAGGGTGCCACAGACAGGGAGAAAGACCCCAACAAAGCT

TCAGCTTCCACCTCCAAGACCCCTGCTTGGCTCCATCATCAGCTGCTGC

CCCCACCTGAGGTCCTGCTGGCCCCGGCCACCTACAGGCCTGTCACGTA

TCAGAGCCTGTACTCTGGAGCCCCGAGCCACCTAGGGATCCCAAGGACC

CGACCAGCACCATACCCCCTCCCCAACATCCGGGCTGATAGGGATCAAG

GAGGCCTGCCTCTCCCAGCTGGGCTGGGGCTCCTGTCCCCCACTGTGGT

GTGCCTGGGGCCTGGCCAGGACTCCCAG, or a nucleic acid sequence that hybridizes to a nucleic acid sequence consisting of SEQ ID NO:106 under stringent hybridization conditions.

In some embodiments, T-box 15 (TBX15) comprises the amino acid sequence:

(SEQ ID NO: 107; NP_689593)

MSSMEEIQVELQCADLWKRFHDIGTEMIITKAGRRMFPAMRVKITGLDP

HQQYYIAMDIVPVDNKRYRYVYHSSKWMVAGNADSPVPPRVYIHPDSLA

SGDTWMRQVVSFDKLKLTNNELDDQGHIILHSMHKYQPRVHVIRKDFSS

DLSPTKPVPVGDGVKTFNFPETVFTTVTAYQNQQITRLKIDRNPFAKGF

RDSGRNRTGLEAIMETYAFWRPPVRTLTFEDFTTMQKQQGGSTGTSPTT

SSTGTPSPSASSHLLSPSCSPPTFHLAPNTFNVGCRESQLCNLNLSDYP

PCARSNMAALQSYPGLSDSGYNRLQSGTTSATQPSETFMPQRTPSLISG

IPTPPSLPGNSKMEAYGGQLGSFPTSQFQYVMQAGNAASSSSSPHMFGG

SHMQQSSYNAFSLHNPYNLYGYNFPTSPRLAASPEKLSASQSTLLCSSP

SNGAFGERQYLPSGMEHSMHMISPSPNNQQATNTCDGRQYGAVPGSSSQ

MSVHMV, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:107.

In some embodiments, the nucleic acid sequence encoding TBX15 comprises the nucleic acid sequence:

(SEQ ID NO: 108; NM_152380)

ATGTCTTCCATGGAGGAGATTCAGGTGGAGCTGCAATGTGCTGACCTCT

GGAAGCGGTTCCATGATATTGGAACTGAAATGATCATCACCAAAGCAGG

CAGGAGGATGTTTCCTGCCATGAGAGTGAAAATCACTGGCCTAGATCCA

CATCAGCAGTACTACATAGCAATGGACATTGTGCCTGTGGACAATAAAA

-continued

GATACAGATATGTGTATCATAGCTCCAAGTGGATGGTGGCTGGCAATGC
TGATTCCCCTGTGCCCCCAAGAGTTTATATACACCCTGATTCTCTAGCT
TCTGGAGACACCTGGATGAGACAGGTGGTCAGTTTTGACAAACTCAAGC
TTACCAACAATGAGTTGGATGATCAAGGACATATCATTCTGCACTCTAT
GCACAAATACCAGCCTCGAGTTCATGTGATTCGCAAAGACTTCAGCAGT
GACCTTTCACCCACTAAGCCTGTTCCTGTTGGGGATGGGGTGAAAACGT
TCAACTTTCCTGAGACTGTGTTCACCACAGTTACGGCCTATCAGAATCA
GCAGATTACCAGATTAAAAATTGACCGAAACCCTTTTGCTAAAGGATTC
AGAGATTCTGGGAGAAACAGAACTGGACTTGAAGCCATCATGGAGACAT
ATGCATTCTGGAGACCTCCTGTGCGCACACTCACCTTCGAAGACTTCAC
CACCATGCAGAAGCAGCAAGGAGGCAGCACAGGCACTTCCCCAACCACC
TCCAGCACTGGGACACCATCCCCTTCGGCTTCTTCTCATCTTTTATCTC
CATCCTGTTCTCCTCCAACTTTTCATCTGGCCCCCAACACTTTCAATGT
GGGCTGCCGAGAAAGCCAGCTGTGTAATCTAAACCTCTCTGATTATCCA
CCATGTGCCCGAAGCAACATGGCTGCCTTGCAGAGCTACCCAGGGCTGA
GTGACAGTGGCTACAACAGGCTTCAGAGTGGCACCACTTCAGCCACTCA
GCCCTCTGAAACCTTCATGCCTCAGAGGACTCCATCCCTGATCTCAGGA
ATACCAACTCCTCCCTCGTTGCCTGGCAACAGCAAGATGGAAGCCTACG
GTGGCCAGCTGGGGTCCTTTCCCACTTCCCAGTTTCAGTATGTCATGCA
GGCAGGCAATGCTGCCTCCAGCTCCTCATCACCACACATGTTCGGGGGC
AGCCACATGCAGCAGAGCTCCTACAATGCCTTCTCCCTTCACAACCCTT
ACAACCTGTATGGATACAATTTCCCCACTTCCCCTAGGCTAGCTGCAAG
CCCGGAAAAACTGAGCGCCTCTCAAAGCACTTTACTCTGTTCTTCTCCT
TCCAACGGGGCCTTTGGAGAGAGGCAGTACCTGCCGTCAGGGATGGAGC
ACAGCATGCACATGATTAGTCCTTCACCCAATAACCAACAGGCAACCAA
CACTTGTGATGGCCGGCAGTATGGGGCAGTTCCAGGCTCCTCCTCCCAG
ATGTCCGTGCACATGGTT, or a nucleic acid sequence that hybridizes to a nucleic acid sequence consisting of SEQ ID NO:108 under stringent hybridization conditions.

In some embodiments, T-box 18 (TBX18) comprises the amino acid sequence:

(SEQ ID NO: 109; NP_001073977)

MAEKRRGSPCSMLSLKAHAFSVEALIGAEKQQQLQKKRRKLGAEEAARA
VDDGGCSRGGGAGEKGSSEGDEGAALPPPAGATSGPARSGADLERGAAG
GCEDGFQQGASPLASPGGSPKGSPARSLARPGTPLPSPQAPRVDLQGAE
LWKRFHEIGTEMIITKAGRRMFPAMRVKISGLDPHQQYYIAMDIVPVDN
KRYRYVYHSSKWMVAGNADSPVPPRVYIHPDSPASGETWMRQVISFDKL
KLTNNELDDQGHIILHSMHKYQPRVHVIRKDCGDDLSPIKPVPSGEGVK
AFSFPETVFTTVTAYQNQQITRLKIDRNPFAKGFRDSGRNRMGLEALVE
SYAFWRPSLRTLTFEDIPGIPKQGNASSSTLLQGTGNGVPATHPHLLSG
SSCSSPAFHLGPNTSQLCSLAPADYSACARSGLTLNRYSTSLAETYNRL
TNQAGETFAPPRTPSYVGVSSSTSVNMSMGGTDGDTFSCPQTSLSMQIS
GMSPQLQYIMPSPSSNAFATNQTHQGSYNTFRLHSPCALYGYNFSTSPK
LAASPEKIVSSQGSFLGSSPSGTMTDRQMLPPVEGVHLLSSGGQQSFFD
SRTLGSLTLSSSQVSAHMV, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:109.

In some embodiments, the nucleic acid sequence encoding TBX18 comprises the nucleic acid sequence (SEQ ID NO: 110; NM_001080508)

ATGGCCGAGAAGCGAAGGGGCTCGCCGTGCAGCATGCTAAGCCTCAAGG
CGCACGCTTTCTCGGTGGAGGCGCTGATCGGCGCCGAGAAGCAGCAACA
GCTTCAGAAGAAGCGGCGAAAACTGGGCGCCGAAGAGGCGGCGAGGGCC
GTGGACGACGGAGGCTGCAGCCGCGGCGGCGGCGCGGGCGAAAAGGGTT
CTTCTGAGGGAGACGAAGGCGCTGCGCTCCCGCCGCCGGCTGGGGCGAC
GTCTGGGCCGGCTCGGAGTGGCGCAGACCTGGAGCGCGGAGCCGCGGGC
GGCTGTGAGGACGGCTTCCAGCAGGGAGCTTCCCCTCTGGCGTCACCGG
GAGGCTCCCCCAAGGGGTCTCCGGCGCGCTCCCTGGCCCGGCCCGGGAC
CCCTCTGCCCTCGCCGCAGGCCCCGCGGGTGGATCTGCAGGGAGCCGAG
CTCTGGAAGCGCTTTCATGAGATAGGCACTGAGATGATCATCACCAAGG
CCGGCAGGCGCATGTTTCCAGCAATGAGAGTGAAGATCTCTGGATTAGA
TCCTCACCAGCAATATTACATTGCCATGGATATTGTACCAGTGGACAAC
AAAAGATACAGGTATGTTTACCACAGTTCGAAATGGATGGTGGCAGGTA
ATGCTGACTCGCCTGTGCCACCCCGTGTGTACATTCATCCAGACTCGCC
TGCCTCGGGGGAGACTTGGATGAGACAAGTTATCAGCTTCGACAAGCTG
AAGCTCACCAACAATGAACTGGATGACCAAGGCCATATTATTCTTCATT
CTATGCACAAATACCAACCGCGAGTGCACGTCATCCGTAAAGACTGTGG
AGACGATCTTTCTCCCATCAAGCCTGTTCCATCCGGGGAGGGAGTAAAG
GCATTCTCCTTTCCAGAAACTGTCTTCACAACCGTCACTGCCTATCAGA
ATCAGCAGATTACTCGCCTGAAGATAGATAGGAATCCATTTGCTAAAGG
CTTCCGAGACTCCGGGCGCAACAGAATGGGTTTGGAAGCCTTGGTGGAA
TCATATGCATTCTGGCGACCATCACTACGGACTCTGACCTTTGAAGATA
TCCCTGGAATTCCCAAGCAAGGCAATGCAAGTTCCTCCACCTTGCTCCA
AGGTACTGGGAATGGCGTTCCTGCCACTCACCCTCACCTTTTGTCTGGC
TCCTCTTGCTCCTCTCCTGCCTTCCATCTGGGGCCCAACACCAGCCAGC
TGTGTAGTCTGGCCCCTGCTGACTATTCTGCCTGTGCCCGCTCAGGCCT
CACCCTCAACCGATACAGCACATCTTTGGCAGAGACCTACAACAGGCTC
ACCAACCAGGCTGGTGAGACCTTTGCCCCGCCCAGGACTCCCTCCTATG
TGGGCGTGAGCAGCAGCACCTCCGTGAACATGTCCATGGGTGGCACTGA
TGGGGACACCTTCAGCTGCCCACAGACCAGCTTATCCATGCAGATTTCG

-continued

```
GGAATGTCCCCCCAGCTCCAGTATATCATGCCATCACCCTCCAGCAATG

CCTTCGCCACTAACCAGACCCATCAGGGTTCCTATAATACTTTTAGATT

ACACAGCCCCTGTGCACTATATGGATATAACTTCTCCACATCCCCCAAA

CTGGCTGCCAGTCCTGAGAAAATTGTTTCTTCCCAAGGAAGTTTCTTGG

GGTCCTCACCGAGTGGGACCATGACGGATCGGCAGATGTTGCCCCCTGT

GGAAGGAGTGCACCTGCTTAGCAGTGGGGTCAGCAGAGTTTCTTTGAC

TCTAGGACCCTAGGAAGCTTAACTCTGTCATCATCTCAAGTATCTGCAC

ATATGGTC,
```

or a nucleic acid sequence that hybridizes to a nucleic acid sequence consisting of SEQ ID NO:110 under stringent hybridization conditions.

In some embodiments, T-box 10 (TBX19) comprises the amino acid sequence:

```
                                (SEQ ID NO: 111; NP_005140)
MAMSELGTRKPSDGTVSHLLNVVESELQAGREKGDPTEKQLQIILEDAP

LWQRFKEVTNEMIVTKNGRRMFPVLKISVTGLDPNAMYSLLLDFVPTDS

HRWKYVNGEWVPAGKPEVSSHSCVYIHPDSPNFGAHWMKAPISFSKVKL

TNKLNGGGQIMLNSLHKYEPQVHIVRVGSAHRMVTNCSFPETQFIAVTA

YQNEEITALKIKYNPFAKAFLDAKERNHLRDVPEAISESQHVTYSHLGG

WIFSNPDGVCTAGNSNYQYAAPLPLPAPHTHHGCEHYSGLRGHRQAPYP

SAYMHRNHSPSVNLIESSSNNLQVFSGPDSVVTSLSSTPHASILSVPHT

NGPINPGPSPYPCLWTISNGAGGPSGPGPEVHASTPGAFLLGNPAVTSP

PSVLSTQAPTSAGVEVLGEPSLTSIAVSTVVTAVASHPFFAGWGGPGAGG

HHSPSSLDG,
```

or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:111.

In some embodiments, the nucleic acid sequence encoding TBX19 comprises the nucleic acid sequence:

```
                                (SEQ ID NO: 112; NM_005149)
ATGGCCATGAGTGAGCTGGGCACTCGGAAGCCCAGCGATGGCACTGTTT

CTCATCTGCTCAATGTGGTGGAGAGTGAGCTTCAGGCAGGGAGGGAAAA

AGGCGACCCTACGGAGAAGCAACTTCAGATCATCCTGGAGGATGCACCT

CTCTGGCAGAGATTCAAGGAAGTCACTAATGAGATGATTGTGACCAAGA

ATGGCAGACGGATGTTTCCAGTCCTAAAGATTAGTGTCACAGGGTTGGA

CCCCAATGCCATGTACTCCCTCCTGCTGGACTTTGTCCCTACGGACAGT

CACCGCTGGAAGTACGTCAACGGGGAATGGGTGCCCGCTGGCAAGCCAG

AGGTCTCCAGCCACAGCTGCGTCTACATTCACCCGGACTCCCCCAACTT

TGGGGCCCACTGGATGAAAGCTCCCATCTCCTTCAGCAAAGTGAAGCTG

ACCAACAAGCTCAATGGAGGCGGGCAGATAATGTTGAATTCTCTGCATA

AATATGAACCCCAGGTTCACATAGTGCGTGTTGGAAGTGCCCATCGAAT

GGTAACAAACTGCTCCTTCCCTGAAACCCAGTTCATAGCCGTGACTGCC
```

-continued

```
TATCAGAATGAGGAGATAACGGCTCTCAAAATCAAGTACAATCCTTTTG

CCAAAGCCTTCTTGGATGCCAAGGAAAGAAATCACCTAAGAGACGTACC

GGAGGCTATCTCTGAGAGCCAGCATGTGACCTATTCTCACTTGGGAGGC

TGGATCTTTTCCAATCCAGATGGAGTGTGCACAGCAGGAAACTCCAATT

ACCAGTATGCCGCTCCTCTGCCTCTGCCTGCTCCCCACACCCACCATGG

CTGTGAGCACTATTCGGGTCTCCGAGGACACCGGCAGGCTCCCTACCCT

TCTGCGTACATGCACAGAAACCATTCTCCCTCAGTGAATTTGATAGAAA

GCTCAAGCAATAATCTGCAAGTTTTCTCGGGACCTGACAGCTGGACTTC

CTTATCCTCCACACCCCATGCCAGCATCCTGTCTGTACCCCACACCAAC

GGACCAATCAATCCAGGGCCCAGCCCCTACCCGTGCCTGTGGACCATCA

GCAATGGTGCCGGAGGCCCCAGTGGGCCAGGCCCGGAGGTGCACGCCAG

CACCCCAGGAGCATTTCTCCTCGGAAACCCAGCTGTGACTTCACCCCCT

TCTGTGCTCTCCACCCAAGCACCCACTTCGGCTGGTGTGGAGGTTCTGG

GGGAGCCCTCGCTAACCAGCATTGCTGTGTCCACCTGGACAGCAGTGGC

CTCGCATCCCTTCGCGGGCTGGGGTGGCCCAGGAGCGGGTGGGCACCAT

TCTCCTTCCTCACTGGATGGT,
```

or a nucleic acid sequence that hybridizes to a nucleic acid sequence consisting of SEQ ID NO:112 under stringent hybridization conditions.

In some embodiments, T-box 20 (TBX20) comprises the amino acid sequence:

```
                                (SEQ ID NO: 113; NP_001159692)
MEFTASPKPQLSSRANAFSIAALMSSGGSKEKEATENTIKPLEQFVEKS

SCAQPLGELTSLDAHGEFGGGSGSSPSSSSLCTEPLIPTTPIIPSEEMA

KIACSLETKELWDKFHELGTEMIITKSGRRMFPTIRVSFSGVDPEAKYI

VLMDIVPVDNKRYRYAYHRSSWLVAGKADPPLPARLYVHPDSPFTGEQL

LKQMVSFEKVKLTNNELDQHGHIILNSMHKYQPRVHIIKKKDHTASLLN

LKSEEFRTFIFPETVFTAVTAYQNQLITKLKIDSNPFAKGFRDSSRLTD

IER,
```

or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:113.

In some embodiments, the nucleic acid sequence encoding TBX20 comprises the nucleic acid sequence:

```
                                (SEQ ID NO: 114; NM_001166220)
ATGGAGTTCACGGCGTCCCCCAAGCCCCAACTCTCCTCCCGGGCCAACG

CCTTCTCCATTGCCGCGCTCATGTCGAGCGGCGGCTCTAAGGAGAAGGA

GGCGACGGAGAACACAATCAAACCCCTGGAGCAATTTGTGGAGAAGTCG

TCCTGTGCCCAGCCCCTGGGTGAGCTGACCAGCCTGGATGCTCATGGGG

AGTTTGGTGGAGGCAGTGGCAGCAGCCCGTCCTCCTCCTCTCTGTGCAC

TGAGCCACTGATCCCCACCACCCCCATCATCCCCAGTGAGGAAATGGCC
```

-continued

AAAATTGCCTGCAGCCTGGAGACCAAGGAGCTTTGGGACAAATTCCATG
AGCTGGGCACCGAGATGATCATCACCAAGTCGGGCAGGAGGATGTTTCC
AACCATCCGGGTGTCCTTTTCGGGGGTGGATCCTGAGGCCAAGTACATA
GTCCTGATGGACATCGTCCCTGTGGACAACAAGAGGTACCGCTACGCCT
ACCACCGGTCCTCCTGGCTGGTGGCTGGCAAGGCCGACCCGCCGTTGCC
AGCCAGGCTCTATGTGCATCCAGATTCTCCTTTTACCGGTGAGCAACTA
CTCAAACAGATGGTGTCTTTTGAAAAGGTGAAACTCACCAACAATGAAC
TGGATCAACATGGCCATATAATTTTGAACTCAATGCATAAGTACCAGCC
AAGGGTGCACATCATTAAGAAGAAAGACCACACAGCCTCATTGCTCAAC
CTGAAGTCTGAAGAATTTAGAACTTTCATCTTTCCAGAAACAGTTTTTA
CGGCAGTCACTGCCTACCAGAATCAACTGATAACGAAGCTGAAAATAGA
TAGCAATCCTTTTGCCAAAGGATTCCGGGATTCCTCCAGGCTCACTGAC
ATTGAGAGGT, or a nucleic acid sequence that hybridizes to a nucleic acid sequence consisting of SEQ ID NO:114 under stringent hybridization conditions.

In some embodiments, T-box 21 (TBX21) comprises the amino acid sequence:

(SEQ ID NO: 115; NP_037483)
MGIVEPGCGDMLTGTEPMPGSDEGRAPGADPQHRYFYPEPGAQDADERR
GGGSLGSPYPGGALVPAPPSRFLGAYAYPPRPQAAGFPGAGESFPPPAD
AEGYQPGEGYAAPDPRAGLYPGPREDYALPAGLEVSGKLRVALNNHLLW
SKFNQHQTEMIITKQGRRMFPFLSFTVAGLEPTSHYRMFVDVVLVDQHH
WRYQSGKWVQCGKAEGSMPGNRLYVHPDSPNTGAHWMRQEVSFGKLKLT
NNKGASNNVTQMIVLQSLHKYQPRLHIVEVNDGEPEAACNASNTHIFTF
QETQFIAVTAYQNAEITQLKIDNNPFAKGFRENFESMYTSVDTSIPSPP
GPNCQFLGGDHYSPLLPNQYPVPSRFYPDLPGQAKDVVPQAYWLGAPRD
HSYEAEFRAVSMKPAFLPSAPGPTMSYYRGQEVLAPGAGWPVAPQYPPK
MGPASWFRPMRTLPMEPGPGGSEGRGPEDQGPPLVWTEIAPIRPESSDS
GLGEGDSKRRRVSPYPSSGDSSSPAGAPSPFDKEAEGQFYNYFPN, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:115.

In some embodiments, the nucleic acid sequence encoding TBX21 comprises the nucleic acid sequence:

(SEQ ID NO: 116; NM_013351)
ATGGGCATCGTGGAGCCGGGTTGCGGAGACATGCTGACGGGCACCGAGCC
GATGCCGGGGAGCGACGAGGGCCGGGCGCCTGGCGCCGACCCGCAGCACC
GCTACTTCTACCCGGAGCCGGGCGCGCAGGACGCGGACGAGCGTCGCGGG
GGCGGCAGCCTGGGGTCTCCCTACCCGGGGGGCGCCTTGGTGCCCGCCCC
GCCGAGCCGCTTCCTTGGAGCCTACGCCTACCCGCCGCGACCCCAGGCGG
CCGGCTTCCCCGGCGCGGGCGAGTCCTTCCCGCCGCCCGCGGACGCCGAG
GGCTACCAGCCGGGCGAGGGCTACGCCGCCCCGGACCCGCGCGCCGGGCT
CTACCCGGGGCCGCGTGAGGACTACGCGCTACCCGCGGGACTGGAGGTGT
CGGGGAAACTGAGGGTCGCGCTCAACAACCACCTGTTGTGGTCCAAGTTT
AATCAGCACCAGACAGAGATGATCATCACCAAGCAGGGACGGCGGATGTT
CCCATTCCTGTCATTTACTGTGGCCGGGCTGGAGCCCACCAGCCACTACA
GGATGTTTGTGGACGTGGTCTTGGTGGACCAGCACCACTGGCGGTACCAG
AGCGGCAAGTGGGTGCAGTGTGGAAAGGCCGAGGGCAGCATGCCAGGAAA
CCGCCTGTACGTCCACCCGGACTCCCCCAACACAGGAGCGCACTGGATGC
GCCAGGAAGTTTCATTTGGGAAACTAAAGCTCACAAACAACAAGGGGGCG
TCCAACAATGTGACCCAGATGATTGTGCTCCAGTCCCTCCATAAGTACCA
GCCCCGGCTGCATATCGTTGAGGTGAACGACGGAGAGCCAGAGGCAGCCT
GCAACGCTTCCAACACGCATATCTTTACTTTCCAAGAAACCCAGTTCATT
GCCGTGACTGCCTACCAGAATGCCGAGATTACTCAGCTGAAAATTGATAA
TAACCCCTTTGCCAAAGGATTCCGGGAGAACTTTGAGTCCATGTACACAT
CTGTTGACACCAGCATCCCCTCCCCGCCTGGACCCAACTGTCAATTCCTT
GGGGGAGATCACTACTCTCCTCTCCTACCCAACCAGTATCCTGTTCCCAG
CCGCTTCTACCCCGACCTTCCTGGCCAGGCGAAGGATGTGGTTCCCCAGG
CTTACTGGCTGGGGGCCCCCCGGGACCACAGCTATGAGGCTGAGTTTCGA
GCAGTCAGCATGAAGCCTGCATTCTTGCCCTCTGCCCCTGGGCCCACCAT
GTCCTACTACCGAGGCCAGGAGGTCCTGGCACCTGGAGCTGGCTGGCCTG
TGGCACCCCAGTACCCTCCCAAGATGGGCCCGGCCAGCTGGTTCCGCCCT
ATGCGGACTCTGCCCATGGAACCCGGCCCTGGAGGCTCAGAGGGACGGGG
ACCAGAGGACCAGGGTCCCCCCTTGGTGTGGACTGAGATTGCCCCCATCC
GGCCGGAATCCAGTGATTCAGGACTGGGCGAAGGAGACTCTAAGAGGAGG
CGCGTGTCCCCCTATCCTTCCAGTGGTGACAGCTCCTCCCCTGCTGGGGC
CCCTTCTCCTTTTGATAAGGAAGCTGAAGGACAGTTTTATAACTATTTTC
CCAAC, or a nucleic acid sequence that hybridizes to a nucleic acid sequence consisting of SEQ ID NO:116 under stringent hybridization conditions.

In some embodiments, T-box 22 (TBX22) comprises the amino acid sequence:

(SEQ ID NO: 117; NP_058650)
MALSSRARAFSVEALVGRPSKRKLQDPIQAEQPELREKKGGEEEEEERRSS
AAGKSEPLEKQPKTEPSTSASSGCGSDSGYGNSSESLEEKDIQMELQGSE
LWKRFHDIGTEMIITKAGRRMFPSVRVKVKGLDPGKQYHVAIDVVPVDSK
RYRYVYHSSQWMVAGNTDHLCIIPRFYVHPDSPCSGETWMRQIISFDRMK
LTNNEMDDKGHIILQSMHKYKPRVHVIEQGSSVDLSQIQSLPTEGVKTFS
FKETEFTTVTAYQNQQITKLKIERNPFAKGFRDTGRNRGVLDGLLETYPW
RPSFTLDFKTFGADTQSGSSGSSPVTSSGGAPSPLNSLLSPLCFSPMFHL
PTSSLGMPCPEAYLPNVNLPLCYKICPTNFWQQQPLVLPAPERLASSNSS

-continued

QSLAPLMMEVPMLSSLGVTNSKSGSSEDSSDQYLQAPNSTNQMLYGLQSP

GNIFLPNSITPEALSCSFHPSYDFYRYNFSMPSRLISGSNHLKVNDDSQV

SFGEGKCNHVHWYPAINHYL, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:117.

In some embodiments, the nucleic acid sequence encoding TBX22 comprises the nucleic acid sequence:

(SEQ ID NO: 118; NM_016954)

ATGGCTCTGAGCTCTCGGGCGCGTGCCTTCTCCGTGGAAGCCTTGGTGGG

GAGACCCAGCAAAAGAAAACTCCAAGACCCAATACAGGCGGAGCAGCCTG

AGCTGCGGGAGAAAAAGGGCGGAGAGGAAGAGGAGGAGAGAAGGAGCAGC

GCTGCAGGGAAGAGCGAGCCGCTTGAAAAACAACCTAAGACAGAGCCCTC

AACATCTGCTTCCTCTGGCTGCGGCAGCGACAGCGGCTACGGCAACAGCT

CTGAAAGTCTGGAAGAGAAAGATATTCAAATGGAGCTTCAAGGATCTGAA

CTGTGGAAAAGATTCCATGACATCGGGACTGAGATGATCATTACTAAAGC

GGGCAGGCGGATGTTCCCCTCTGTTCGGGTCAAGGTGAAAGGGTTGGATC

CAGGGAAGCAGTACCATGTGGCCATCGATGTGGTGCCGGTGGATTCCAAA

CGCTATAGGTACGTCTATCACAGCTCACAGTGGATGGTAGCTGGGAATAC

AGACCATTTGTGCATCATTCCTAGATTCTATGTTCACCCGGACTCACCCT

GCTCGGGAGAGACCTGGATGCGGCAGATCATCAGCTTTGATCGCATGAAA

CTCACCAACAATGAGATGGATGACAAAGGCCACATCATTCTGCAATCCAT

GCATAAGTACAAACCCCGAGTGCACGTGATAGAGCAAGGCAGCAGTGTTG

ACCTGTCCCAGATTCAGTCCTTGCCCACTGAAGGTGTTAAAACATTCTCC

TTTAAAGAAACTGAGTTCACCACAGTAACGGCTTACCAAAACCAACAGAT

TACGAAACTAAAAATAGAAAGAAATCCTTTTGCTAAAGGATTTAGAGATA

CTGGAAGAAACAGGGGTGTATTGGATGGGCTTTTAGAGACCTACCCATGG

AGGCCTTCTTTCACTCTCGATTTTAAAACCTTTGGCGCAGACACACAAAG

TGGAAGCAGTGGCTCATCTCCAGTGACCTCTAGTGGAGGGGCCCCCTCTC

CTTTGAACTCCTTACTTTCTCCACTTTGCTTTTCACCTATGTTTCATTTA

CCTACAAGCTCCCTTGGAATGCCCTGTCCAGAGGCATACCTGCCCAATGT

CAACCTGCCTCTATGCTACAAGATTTGTCCAACTAATTTTTGGCAACAGC

AACCTCTTGTTTTACCGGCTCCTGAAAGACTAGCAAGCAGCAACAGTTCT

CAGTCTTTAGCCCCACTCATGATGGAAGTGCCTATGTTATCTTCCCTGGG

GGTCACCAATTCAAAAAGCGGTTCATCTGAAGACTCCAGTGATCAGTATC

TACAAGCACCTAATTCTACCAATCAAATGTTATATGGATTACAGTCACCT

GGAAATATTTTTCTGCCAAACTCCATCACCCCAGAAGCACTTAGTTGCTC

CTTTCATCCTTCCTATGACTTTTATAGATACAATTTCTCTATGCCATCTA

GACTGATAAGTGGTTCCAACCATCTTAAAGTGAATGACGACAGTCAAGTT

TCTTTTGGAGAAGGCAAATGTAATCATGTTCATTGGTATCCAGCAATTAA

CCATTACCTT, or a nucleic acid sequence that hybridizes to a nucleic acid sequence consisting of SEQ ID NO:118 under stringent hybridization conditions.

In some embodiments, Paired box 1 (PAX1) comprises the amino acid sequence:

(SEQ ID NO: 119; NP_006183)

MEQTYGEVNQLGGVFVNGRPLPNAIRLRIVELAQLGIRPCDISRQLRVSH

GCVSKILARYNETGSILPGAIGGSKPRVTTPNVVKHIRDYKQGDPGIFAW

EIRDRLLADGVCDKYNVPSVSSISRILRNKIGSLAQPGPYEASKQPPSQP

TLPYNHIYQYPYPSPVSPTGAKMGSHPGVPGTAGHVSIPRSWPSAHSVSN

ILGIRTFMEQTGALAGSEGTAYSPKMEDWAGVNRTAFPATPAVNGLEKPA

LEADIKYTQSASTLSAVGGFLPACAYPASNQHGVYSAPGGGYLAPGPPWP

PAQGPPLAPPGAGVAVHGGELAAAMTFKHPSREGSLPAPAARPRTPSVAY

TDCPSRPRPPRGSSPRTRARRERQADPGAQVCAAAPAIGTGRIGGLAEEE

ASAGPRGARPASPQAQPCLWPDPPHFLYWSGFLGFSELGF, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:119.

In some embodiments, the nucleic acid sequence encoding PAX1 comprises the nucleic acid sequence:

(SEQ ID NO: 120; NM_006192)

ATGGAGCAGACGTATGGCGAGGTGAACCAGCTGGGCGGTGTGTTCGTCAA

CGGCCGCCCCCTGCCCAACGCCATCCGCTTGCGCATTGTGGAGCTGGCGC

AGCTGGGCATCCGACCCTGTGACATCAGTCGGCAGCTCCGCGTATCCCAC

GGCTGCGTGAGCAAGATCCTGGCGCGCTACAACGAGACCGGCTCCATTCT

GCCCGGGGCCATCGGGGGGAGCAAGCCCCGCGTCACCACTCCCAACGTGG

TCAAGCACATCCGGGACTACAAGCAAGGAGACCCTGGCATCTTTGCCTGG

GAGATCCGCGACCGGCTGCTGGCCGACGGCGTCTGTGACAAGTACAATGT

GCCTTCGGTGAGCTCCATCAGCCGCATCCTGCGCAACAAGATCGGCAGCC

TGGCGCAGCCCGGACCGTACGAGGCAAGTAAGCAGCCGCCGTCGCAGCCT

ACGCTGCCCTACAACCACATCTACCAGTACCCCTACCCCAGTCCCGTGTC

GCCCACGGGCGCCAAGATGGGCAGCCACCCCGGGGTCCCGGGCACGGCGG

GCCACGTCAGCATCCCGCGCTCATGGCCCTCGGCACACTCGGTCAGCAAC

ATCCTGGGCATCCGGACGTTTATGGAGCAAACAGGGGCCCTGGCTGGGAG

CGAAGGCACCGCTTACTCTCCCAAGATGGAAGACTGGGCCGGCGTGAACC

GCACGGCCTTCCCCGCCACCCCCGCAGTGAATGGGCTAGAGAAACCTGCC

TTAGAGGCAGACATTAAATACACTCAGTCGGCCTCCACCCTCTCTGCCGT

GGGCGGCTTTCTCCCCGCCTGCGCCTACCCGGCCTCCAACCAGCACGGCG

TGTACAGCGCCCCGGGCGGCGGCTACCTCGCCCCGGGCCCGCCGTGGCCG

CCTGCGCAAGGTCCTCCTCTGGCGCCCCCCGGGGCCGGCGTAGCTGTGCA

TGGCGGGGAACTCGCGGCAGCAATGACCTTCAAGCATCCCAGCCGAGAAG

GAAGCCTCCCAGCTCCGGCAGCAAGGCCCCGGACGCCCTCAGTAGCTTAC

ACGGACTGCCCATCCCGGCCTCGACCTCCTAGGGGCAGCTCTCCCCGGAC

CCGAGCCCGGAGGGAACGGCAGGCGGACCCGGGCGCACAGGTCTGCGCGG

CGGCCCCGGCAATCGGCACGGGCAGGATCGGAGGACTCGCGGAGGAGGAA

GCCAGTGCCGGCCCGCGGGGTGCACGCCCAGCCAGCCCCCAGGCCCAGCC

CTGCCTCTGGCCGGACCCACCACACTTCCTTTATTGGTCTGGGTTTTTAG

GCTTCTCTGAACTTGGGTTT, or a nucleic acid sequence that hybridizes to a nucleic acid sequence consisting of SEQ ID NO:120 under stringent hybridization conditions.

In some embodiments, Sex determining region Y (SRY/SOXA) comprises the amino acid sequence:

(SEQ ID NO: 121; NP_003131)
MQSYASAMLSVFNSDDYSPAVQENIPALRRSSSFLCTESCNSKYQCETGE

NSKGNVQDRVKRPMNAFIVWSRDQRRKMALENPRMRNSEISKQLGYQWKM

LTEAEKWPFFQEAQKLQAMHREKYPNYKYRPRRKAKMLPKNCSLLPADPA

SVLCSEVQLDNRLYRDDCTKATHSRMEHOLGHLPPINAASSPQQRDRYSH

WTKL, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:121.

In some embodiments, the nucleic acid sequence encoding SRY/SOXA comprises the nucleic acid sequence:

(SEQ ID NO: 122; NM_003140)
ATGCAATCATATGCTTCTGCTATGTTAAGCGTATTCAACAGCGATGATTA

CAGTCCAGCTGTGCAAGAGAATATTCCCGCTCTCCGGAGAAGCTCTTCCT

TCCTTTGCACTGAAAGCTGTAACTCTAAGTATCAGTGTGAAACGGGAGAA

AACAGTAAAGGCAACGTCCAGGATAGAGTGAAGCGACCCATGAACGCATT

CATCGTGTGGTCTCGCGATCAGAGGCGCAAGATGGCTCTAGAGAATCCCA

GAATGCGAAACTCAGAGATCAGCAAGCAGCTGGGATACCAGTGGAAAATG

CTTACTGAAGCCGAAAAATGGCCATTCTTCCAGGAGGCACAGAAATTACA

GGCCATGCACAGAGAGAAATACCCGAATTATAAGTATCGACCTCGTCGGA

AGGCGAAGATGCTGCCGAAGAATTGCAGTTTGCTTCCCGCAGATCCCGCT

TCGGTACTCTGCAGCGAAGTGCAACTGGACAACAGGTTGTACAGGGATGA

CTGTACGAAAGCCACACACTCAAGAATGGAGCACCAGCTAGGCCACTTAC

CGCCCATCAACGCAGCCAGCTCACCGCAGCAACGGGACCGCTACAGCCAC

TGGACAAAGCTG, or a nucleic acid sequence that hybridizes to a nucleic acid sequence consisting of SEQ ID NO:122 under stringent hybridization conditions.

In some embodiments, SRY box 1 (SOX1) comprises the amino acid sequence:

(SEQ ID NO: 123; NP_005977)
MYSMMMETDLHSPGGAQAPTNLSGPAGAGGGGGGGGGGGGGAKANQDR

VKRPMNAFMVWSRGQRRKMAQENPKMHNSEISKRLGAEWKVMSEAEKRPF

IDEAKRLRALHMKEHPDYKYRPRRKTKTLLKKDKYSLAGGLLAAGAGGGG

AAVAMGVGVGVGAAAVGQRLESPGGAAGGGYAHVNGWANGAYPGSVAAAA

AAAAMMQEAQLAYGQHPGAGGAHPHAHPAHPHPHHPHAHPHNPQPMHRYD

MGALQYSPISNSQGYMSASPSGYGGLPYGAAAAAAAAAGGAHQNSAVAAA

AAAAAASSGALGALGSLVKSEPSGSPPAPAHSRAPCPGDLREMISMYLPA

GEGGDPAAAAAAAAQSRLHSLPQHYQGAGAGVNGTVPLTHI, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:123.

In some embodiments, the nucleic acid sequence encoding SOX1 comprises the nucleic acid sequence:

(SEQ ID NO: 124; NM_005986)
ATGTACAGCATGATGATGGAGACCGACCTGCACTCGCCCGGCGGCGCCCA

GGCCCCCACGAACCTCTCGGGCCCCGCCGGGGCGGGCGGCGGCGGGGGCG

GAGGCGGGGGCGGCGGCGGCGGCGGGGGCGCCAAGGCCAACCAGGACCGG

GTCAAACGGCCCATGAACGCCTTCATGGTGTGGTCCCGCGGGCAGCGGCG

CAAGATGGCCCAGGAGAACCCCAAGATGCACAACTCGGAGATCAGCAAGC

GCCTGGGGGCCGAGTGGAAGGTCATGTCCGAGGCCGAGAAGCGGCCGTTC

ATCGACGAGGCCAAGCGGCTGCGCGCGCTGCACATGAAGGAGCACCCGGA

TTACAAGTACCGGCCGCGCCGCAAGACCAAGACGCTGCTCAAGAAGGACA

AGTACTCGCTGGCCGGCGGGCTCCTGGCGGCCGGCGCGGGTGGCGGCGGC

GCGGCTGTGGCCATGGGCGTGGGCGTGGGCGTGGGCGCGGCGGCCGTGGG

CCAGCGCCTGGAGAGCCCAGGCGGCGCGGCGGGCGGCGGCTACGCGCACG

TCAACGGCTGGGCCAACGGCGCCTACCCCGGCTCGGTGGCGGCGGCGGCG

GCGGCCGCGGCCATGATGCAGGAGGCGCAGCTGGCCTACGGGCAGCACCC

GGGCGCGGGCGGCGCGCACCCGCACGCGCACCCCGCGCACCCGCACCCGC

ACCACCCGCACGCGCACCCGCACAACCCGCAGCCCATGCACCGCTACGAC

ATGGGCGCGCTGCAGTACAGCCCCATCTCCAACTCGCAGGGCTACATGAG

CGCGTCGCCCTCGGGCTACGGCGGCCTCCCCTACGGCGCCGCGGCCGCCG

CCGCCGCCGCTGCGGGCGGCGCGCACCAGAACTCGGCCGTGGCGGCGGCG

GCGGCGGCGGCGGCCGCGTCGTCGGGCGCCCTGGGCGCGCTGGGCTCTCT

GGTGAAGTCGGAGCCCAGCGGCAGCCCGCCCGCCCCAGCGCACTCGCGGG

CGCCGTGCCCCGGGGACCTGCGCGAGATGATCAGCATGTACTTGCCCGCC

GGCGAGGGGGGCGACCCGGCGGCGGCAGCAGCGGCCGCGGCGCAGAGCCG

GCTGCACTCGCTGCCGCAGCACTACCAGGGCGCGGGCGCGGGCGTGAACG

GCACGGTGCCCCTGACGCACATC, or a nucleic acid sequence that hybridizes to a nucleic acid sequence consisting of SEQ ID NO:124 under stringent hybridization conditions.

In some embodiments, SRY-box 2 (SOX2) comprises the amino acid sequence:

(SEQ ID NO: 125; NP_003097)
MYNMMETELKPPGPQQTSGGGGGNSTAAAAGGNQKNSPDRVKRPMNAFMV

WSRGQRRKMAQENPKMHNSEISKRLGAEWKLLSETEKRPFIDEAKRLRAL

HMKEHPDYKYRPRRKTKTLMKKDKYTLPGGLLAPGGNSMASGVGVGAGLG

AGVNQRMDSYAHMNGWSNGSYSMMQDQLGYPQHPGLNAHGAAQMQPMHRY

DVSALQYNSMTSSQTYMNGSPTYSMSYSQQGTPGMALGSMGSVVKSEASS

SPPVVTSSSHSRAPCQAGDLRDMISMYLPGAEVPEPAAPSRLHMSQHYQS

GPVPGTAINGTLPLSHM, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:125.

In some embodiments, the nucleic acid sequence encoding SOX2 comprises the nucleic acid sequence:

(SEQ ID NO: 126; NM_003106)
ATGTACAACATGATGGAGACGGAGCTGAAGCCGCCGGGCCCGCAGCAAAC

TTCGGGGGGCGGCGGCGGCAACTCCACCGCGGCGGCGGCCGGCGGCAACC

AGAAAAACAGCCCGGACCGCGTCAAGCGGCCCATGAATGCCTTCATGGTG

TGGTCCCGCGGGCAGCGGCGCAAGATGGCCCAGGAGAACCCCAAGATGCA

CAACTCGGAGATCAGCAAGCGCCTGGGCGCCGAGTGGAAACTTTTGTCGG

AGACGGAGAAGCGGCCGTTCATCGACGAGGCTAAGCGGCTGCGAGCGCTG

CACATGAAGGAGCACCCGGATTATAAATACCGGCCCCGGCGGAAAACCAA

GACGCTCATGAAGAAGGATAAGTACACGCTGCCCGGCGGGCTGCTGGCCC

CCGGCGGCAATAGCATGGCGAGCGGGGTCGGGGTGGGCGCCGGCCTGGGC

GCGGGCGTGAACCAGCGCATGGACAGTTACGCGCACATGAACGGCTGGAG

CAACGGCAGCTACAGCATGATGCAGGACCAGCTGGGCTACCCGCAGCACC

CGGGCCTCAATGCGCACGGCGCAGCGCAGATGCAGCCCATGCACCGCTAC

GACGTGAGCGCCCTGCAGTACAACTCCATGACCAGCTCGCAGACCTACAT

GAACGGCTCGCCCACCTACAGCATGTCCTACTCGCAGCAGGGCACCCCTG

GCATGGCTCTTGGCTCCATGGGTTCGGTGGTCAAGTCCGAGGCCAGCTCC

AGCCCCCCTGTGGTTACCTCTTCCTCCCACTCCAGGGCGCCCTGCCAGGC

CGGGGACCTCCGGGACATGATCAGCATGTATCTCCCCGGCGCCGAGGTGC

CGGAACCCGCCGCCCCCAGCAGACTTCACATGTCCCAGCACTACCAGAGC

GGCCCGGTGCCCGGCACGGCCATTAACGGCACACTGCCCCTCTCACACAT

G, or a nucleic acid sequence that hybridizes to a nucleic acid sequence consisting of SEQ ID NO:126 under stringent hybridization conditions.

In some embodiments, SRY-box 3 (SOX3) comprises the amino acid sequence:

(SEQ ID NO: 127; NP_005625)
MRPVRENSSGARSPRVPADLARSILISLPFPPDSLAHRPPSSAPTESQGL

FTVAAPAPGAPSPPATLAHLLPAPAMYSLLETELKNPVGTPTQAAGTGGP

AAPGGAGKSSANAAGGANSGGGSSGGASGGGGGTDQDRVKRPMNAFMVWS

RGQRRKMALENPKMHNSEISKRLGADWKLLTDAEKRPFIDEAKRLRAVHM

KEYPDYKYRPRRKTKTLLKKDKYSLPSGLLPPGAAAAAAAAAAAAAAASS

PVGVGQRLDTYTHVNGWANGAYSLVQEQLGYAQPPSMSSPPPPPALPPMH

RYDMAGLQYSPMMPPGAQSYMNVAAAAAAASGYGGMAPSATAAAAAAYGQ

QPATAAAAAAAAAAMSLGPMGSVVKSEPSSPPPAIASHSQRACLGDLRDM

ISMYLPPGGDAADAASPLPGGRLHGVHQHYQGAGTAVNGTVPLTHI, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:127.

In some embodiments, the nucleic acid sequence encoding SOX3 comprises the nucleic acid sequence:

(SEQ ID NO: 128; NM_005634)
ATGCGACCTGTTCGAGAGAACTCATCAGGTGCGAGAAGCCCGCGGGTTCC

TGCTGATTTGGCGCGGAGCATTTTGATAAGCCTACCCTTCCCGCCGGACT

CGCTGGCCCACAGGCCCCCAAGCTCCGCTCCGACGGAGTCCCAGGGCCTT

TTCACCGTGGCCGCTCCAGCCCCGGGAGCGCCTTCTCCTCCCGCCACGCT

GGCGCACCTTCTTCCCGCCCCGGCAATGTACAGCCTTCTGGAGACTGAAC

TCAAGAACCCCGTAGGGACACCCACACAAGCGGCGGGCACCGGCGGCCCC

GCAGCCCCGGGAGGCGCAGGCAAGAGTAGTGCGAACGCAGCCGGCGGCGC

GAACTCGGGCGGCGGCAGCAGCGGTGGTGCGAGCGGAGGTGGCGGGGGTA

CAGACCAGGACCGTGTGAAACGGCCCATGAACGCCTTCATGGTATGGTCC

CGCGGGCAGCGGCGCAAAATGGCCCTGGAGAACCCCAAGATGCACAATTC

TGAGATCAGCAAGCGCTTGGGCGCCGACTGGAAACTGCTGACCGACGCCG

AGAAGCGACCATTCATCGACGAGGCCAAGCGACTTCGCGCCGTGCACATG

AAGGAGTATCCGGACTACAAGTACCGACCGCGCCGCAAGACCAAGACGCT

GCTCAAGAAAGATAAGTACTCCCTGCCCAGCGGCCTCCTGCCTCCCGGTG

CCGCGGCCGCCGCCGCCGCTGCCGCGGCCGCAGCCGCTGCCGCCAGCAGT

CCGGTGGGCGTGGGCCAGCGCCTGGACACGTACACGCACGTGAACGGCTG

GGCCAACGGCGCGTACTCGCTGGTGCAGGAGCAGCTGGGCTACGCGCAGC

CCCCGAGCATGAGCAGCCCGCCGCCGCCGCCCGCGCTGCCGCCGATGCAC

CGCTACGACATGGCCGGCCTGCAGTACAGCCCAATGATGCCGCCCGGCGC

TCAGAGCTACATGAACGTCGCTGCCGCGGCCGCCGCCGCCTCGGGCTACG

GGGGCATGGCGCCCTCAGCCACAGCAGCCGCGGCCGCCGCCTACGGGCAG

CAGCCCGCCACCGCCGCGGCCGCAGCTGCGGCCGCAGCCGCCATGAGCCT

GGGCCCCATGGGCTCGGTAGTGAAGTCTGAGCCCAGCTCGCCGCCGCCCG

-continued

CCATCGCATCGCACTCTCAGCGCGCGTGCCTCGGCGACCTGCGCGACATG

ATCAGCATGTACCTGCCACCCGGCGGGGACGCGGCCGACGCCGCCTCTCC

GCTGCCCGGCGGTCGCCTGCACGGCGTGCACCAGCACTACCAGGGCGCCG

GGACTGCAGTCAACGGAACGGTGCCGCTGACCCACATC, or a nucleic acid sequence that hybridizes to a nucleic acid sequence consisting of SEQ ID NO:128 under stringent hybridization conditions.

In some embodiments, SRY box 14 (SOX14) comprises the amino acid sequence:

(SEQ ID NO: 129; NP_004180)

MSKPSDHIKRPMNAFMVWSRGQRRKMAQENPKMHNSEISKRLGAEWKLLS

EAEKRPYIDEAKRLRAQHMKEHPDYKYRPRRKPKNLLKKDRYVFPLPYLG

DTDPLKAAGLPVGASDGLLSAPEKARAFLPPASAPYSLLDPAQFSSSAIQ

KMGEVPHTLATGALPYASTLGYQNGAFGSLSCPSQHTHTHPSPTNPGYVV

PCNCTAWSASTLQPPVAYILFPGMTKTGIDPYSSAHATAM, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:129.

In some embodiments, the nucleic acid sequence encoding SOX14 comprises the nucleic acid sequence:

(SEQ ID NO: 130; NM_004189)

ATGTCCAAACCTTCAGACCACATCAAGCGGCCCATGAACGCCTTCATGGT

ATGGTCCCGGGGCCAGCGGCGCAAGATGGCCCAGGAAAACCCCAAGATGC

ACAACTCGGAGATCAGCAAACGCCTAGGTGCCGAATGGAAGCTTCTGTCC

GAGGCAGAGAAGCGGCCATACATCGATGAAGCCAAGCGGCTACGCGCCCA

GCACATGAAGGAGCACCCTGACTACAAGTACCGACCTCGGCGCAAGCCCA

AGAACCTGCTCAAGAAGGACAGGTATGTCTTCCCCTTGCCCTACCTGGGC

GACACGGACCCGCTCAAGGCGGCTGGCCTGCCCGTGGGGGCCTCCGACGG

CCTCCTGAGCGCGCCCGAGAAAGCCCGGGCCTTCTTGCCGCCGGCCTCGG

CGCCCTACTCCCTGCTGGACCCCGCGCAGTTTAGCTCGAGCGCCATCCAG

AAGATGGGCGAAGTGCCCCACACCTTGGCTACCGGCGCTCTGCCCTACGC

GTCCACCCTGGGCTACCAGAACGGCGCCTTCGGCAGCCTCAGCTGCCCCA

GCCAGCACACGCACACGCACCCGTCCCCCACCAACCCTGGCTACGTGGTG

CCCTGTAACTGTACCGCCTGGTCTGCCTCCACCCTGCAGCCCCCCGTCGC

CTACATCCTCTTCCCAGGCATGACCAAGACTGGCATAGACCCTTATTCGT

CAGCCCACGCTACGGCCATG, or a nucleic acid sequence that hybridizes to a nucleic acid sequence consisting of SEQ ID NO:130 under stringent hybridization conditions.

In some embodiments, SRY-box 21 (SOX21) comprises the amino acid sequence:

(SEQ ID NO: 131; NP_009015)

MSKPVDHVKRPMNAFMVWSRAQRRKMAQENPKMHNSEISKRLGAEWKLLT

ESEKRPFIDEAKRLRAMHMKEHPDYKYRPRRKPKTLLKKDKFAFPVPYGL

GGVADAEHPALKAGAGLHAGAGGGLVPESLLANPEKAAAAAAAAAARVFF

PQSAAAAAAAAAAAAAGSPYSLLDLGSKMAEISSSSSGLPYASSLGYPTA

GAGAFHGAAAAAAAAAAAAGGHTHSHPSPGNPGYMIPCNCSAWPSPGLQP

PLAYILLPGMGKPQLDPYPAAYAAAL, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:131.

In some embodiments, the nucleic acid sequence encoding SOX21 comprises the nucleic acid sequence:

(SEQ ID NO: 132; NM_007084)

ATGTCCAAGCCGGTGGACCACGTCAAGCGGCCCATGAACGCCTTCATG

GTGTGGTCGCGGGCTCAGCGGCGCAAGATGGCCCAGGAGAACCCCAAG

ATGCACAACTCGGAGATCAGCAAGCGCTTGGGCGCCGAGTGGAAACTG

CTCACAGAGTCGGAGAAGCGGCCGTTCATCGACGAGGCCAAGCGTCTA

CGCGCCATGCACATGAAGGAGCACCCCGACTACAAGTACCGGCCGCGG

CGCAAGCCCAAGACGCTGCTCAAGAAGGACAAGTTCGCCTTCCCGGTG

CCCTACGGCCTGGGCGGCGTGGCGGACGCCGAGCACCCTGCGCTCAAG

GCGGGCGCCGGGCTGCACGCGGGGGCGGGCGGCGGCCTGGTGCCTGAG

TCGCTGCTCGCCAATCCCGAGAAGGCGGCCGCGGCCGCCGCCGCTGCC

GCCGCACGCGTCTTCTTCCCGCAGTCGGCCGCTGCCGCCGCCGCTGCC

GCCGCCGCCGCCGCCGCGGGCAGCCCCTACTCGCTGCTCGACCTGGGC

TCCAAAATGGCAGAGATCTCGTCGTCCTCGTCCGGCCTCCCGTACGCG

TCGTCGCTGGGCTACCCGACCGCGGGCGCGGGCGCCTTCCACGGCGCG

GCGGCGGCGGCTGCAGCGGCGGCCGCCGCCGCCGGGGGGCACACGCAC

TCGCACCCCAGCCCGGGCAACCCGGGCTACATGATCCCGTGCAACTGC

AGCGCGTGGCCCAGCCCCGGGCTGCAGCCGCCGCTCGCCTACATCCTG

CTGCCGGGCATGGGCAAGCCCCAGCTGGACCCCTACCCCGCGGCCTAC

GCTGCCGCGCTA, or a nucleic acid sequence that hybridizes to a nucleic acid sequence consisting of SEQ ID NO:132 under stringent hybridization conditions.

In some embodiments, SRY-box 4 (SOX4) comprises the amino acid sequence:

(SEQ ID NO: 133; NP_003098)

MVQQTNNAENTEALLAGESSDSGAGLELGIASSPTPGSTASTGGKADD

PSWCKTPSGHIKRPMNAFMVWSQIERRKIMEQSPDMHNAEISKRLGKR

WKLLKDSDKIPFIREAERLRLKHMADYPDYKYRPRKKVKSGNANSSSS

AAASSKPGEKGDKVGGSGGGGHGGGGGGSSNAGGGGGGASGGGANSK

-continued

PAQKKSCGSKVAGGAGGGVSKPHAKLILAGGGGGGKAAAAAAASFAAE

QAGAAALLPLGAAADHHSLYKARTPSASASASSAASASAALAAPGKHL

AEKKVKRVYLFGGLGTSSSPVGGVGAGADPSDPLGLYEEEGAGCSPDA

PSLSGRSSAASSPAAGRSPADHRGYASLRAASPAPSSAPSHASSSASS

HSSSSSSSGSSSSDDEFEDDLLDLNPSSNFESMSLGSFSSSSALDRDL

DFNFEPGSGSHFEFPDYCTPEVSEMISGDWLESSISNLVFTY, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:133.

In some embodiments, the nucleic acid sequence encoding SOX4 comprises the nucleic acid sequence:

(SEQ ID NO: 134; NM_003107)

ATGGTGCAGCAAACCAACAATGCCGAGAACACGGAAGCGCTGCTGGCC

GGCGAGAGCTCGGACTCGGGCGCCGGCCTCGAGCTGGGAATCGCCTCC

TCCCCCACGCCCGGCTCCACCGCCTCCACGGGCGGCAAGGCCGACGAC

CCGAGCTGGTGCAAGACCCCGAGTGGGCACATCAAGCGACCCATGAAC

GCCTTCATGGTGTGGTCGCAGATCGAGCGGCGCAAGATCATGGAGCAG

TCGCCCGACATGCACAACGCCGAGATCTCCAAGCGGCTGGGCAAACGC

TGGAAGCTGCTCAAAGACAGCGACAAGATCCCTTTCATTCGAGAGGCG

GAGCGGCTGCGCCTCAAGCACATGGCTGACTACCCCGACTACAAGTAC

CGGCCCAGGAAGAAGGTGAAGTCCGGCAACGCCAACTCCAGCTCCTCG

GCCGCCGCCTCCTCCAAGCCGGGGGAGAAGGGAGACAAGGTCGGTGGC

AGTGGCGGGGGCGGCCATGGGGGCGGCGGCGGCGGCGGGAGCAGCAAC

GCGGGGGGAGGAGGCGGCGGTGCGAGTGGCGGCGGCGCCAACTCCAAA

CCGGCGCAGAAAAAGAGCTGCGGCTCCAAAGTGGCGGGCGGCGCGGGC

GGTGGGGTTAGCAAACCGCACGCCAAGCTCATCCTGGCAGGCGGCGGC

GGCGGCGGGAAAGCAGCGGCTGCCGCCGCCGCCTCCTTCGCCGCCGAA

CAGGCGGGGGCCGCCGCCCTGCTGCCCCTGGGCGCCGCCGCCGACCAC

CACTCGCTGTACAAGGCGCGGACTCCCAGCGCCTCGGCCTCCGCCTCC

TCGGCAGCCTCGGCCTCCGCAGCGCTCGCGGCCCCGGGCAAGCACCTG

GCGGAGAAGAAGGTGAAGCGCGTCTACCTGTTCGGCGGCCTGGGCACG

TCGTCGTCGCCCGTGGGCGGCGTGGGCGCGGGAGCCGACCCCAGCGAC

CCCCTGGGCCTGTACGAGGAGGAGGGCGCGGGCTGCTCGCCCGACGCG

CCCAGCCTGAGCGGCCGCAGCAGCGCCGCCTCGTCCCCCGCCGCCGGC

CGCTCGCCCGCCGACCACCGCGGCTACGCCAGCCTGCGCGCCGCCTCG

CCCGCCCCGTCCAGCGCGCCCTCGCACGCGTCCTCCTCGGCCTCGTCC

CACTCCTCCTCTTCCTCCTCCTCGGGCTCCTCGTCCTCCGACGACGAG

TTCGAAGACGACCTGCTCGACCTGAACCCCAGCTCAAACTTTGAGAGC

ATGTCCCTGGGCAGCTTCAGTTCGTCGTCGGCGCTCGACCGGGACCTG

GATTTTAACTTCGAGCCCGGCTCCGGCTCGCACTTCGAGTTCCCGGAC

-continued

TACTGCACGCCCGAGGTGAGCGAGATGATCTCGGGAGACTGGCTCGAG

TCCAGCATCTCCAACCTGGTTTTCACCTAC, or a nucleic acid sequence that hybridizes to a nucleic acid sequence consisting of SEQ ID NO:134 under stringent hybridization conditions.

In some embodiments, SRY-box 11 (SOX11) comprises the amino acid sequence:

(SEQ ID NO: 135; NP_003099)

MVQQAESLEAESNLPREALDTEEGEFMACSPVALDESDPDWCKTASGH

IKRPMNAFMVWSKIERRKIMEQSPDMHNAEISKRLGKRWKMLKDSEKI

PFIREAERLRLKHMADYPDYKYRPRKKPKMDPSAKPSASQSPEKSAAG

GGGGSAGGGAGGAKTSKGSSKKCGKLKAPAAAGAKAGAGKAAQSGDYG

GAGDDYVLGSLRVSGSGGGGAGKTVKCVFLDEDDDDDDDDDELQLQIK

QEPDEEDEEPPHQQLLQPPGQQPSQLLRRYNVAKVPASPTLSSSAESP

EGASLYDEVRAGATSGAGGGSRLYYSFKNITKQHPPPLAQPALSPASS

RSVSTSSSSSSGSSSGSSGEDADDLMFDLSLNFSQSAHSASEQQLGGG

AAAGNLSLSLVDKDLDSFSEGSLGSHFEFPDYCTPELSEMIAGDWLEA

NFSDLVFTY, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:135.

In some embodiments, the nucleic acid sequence encoding SOX11 comprises the nucleic acid sequence:

(SEQ ID NO: 136; NM_003108)

ATGGTGCAGCAGGCGGAGAGCTTGGAAGCGGAGAGCAACCTGCCCCGG

GAGGCGCTGGACACGGAGGAGGGCGAATTCATGGCTTGCAGCCCGGTG

GCCCTGGACGAGAGCGACCCAGACTGGTGCAAGACGGCGTCGGGCCAC

ATCAAGCGGCCGATGAACGCGTTCATGGTATGGTCCAAGATCGAACGC

AGGAAGATCATGGAGCAGTCTCCGGACATGCACAACGCCGAGATCTCC

AAGAGGCTGGGCAAGCGCTGGAAAATGCTGAAGGACAGCGAGAAGATC

CCGTTCATCCGGGAGGCGGAGCGGCTGCGGCTCAAGCACATGGCCGAC

TACCCCGACTACAAGTACCGGCCCCGGAAAAAGCCCAAAATGGACCCC

TCGGCCAAGCCCAGCGCCAGCCAGAGCCCAGAGAAGAGCGCGGCCGGC

GGCGGCGGCGGGAGCGCGGGCGGAGGCGCGGGCGGTGCCAAGACCTCC

AAGGGCTCCAGCAAGAAATGCGGCAAGCTCAAGGCCCCCGCGGCCGCG

GGCGCCAAGGCGGGCGCGGGCAAGGCGGCCCAGTCCGGGGACTACGGG

GGCGCGGGCGACGACTACGTGCTGGGCAGCCTGCGCGTGAGCGGCTCG

GGCGGCGGCGGCGCGGGCAAGACGGTCAAGTGCGTGTTTCTGGATGAG

GACGACGACGACGACGACGACGACGACGAGCTGCAGCTGCAGATCAAA

CAGGAGCCGGACGAGGAGGACGAGGAACCACCGCACCAGCAGCTCCTG

CAGCCGCCGGGGCAGCAGCCGTCGCAGCTGCTGAGACGCTACAACGTC

GCCAAAGTGCCCGCCAGCCCTACGCTGAGCAGCTCGGCGGAGTCCCCC

-continued

GAGGGAGCGAGCCTCTACGACGAGGTGCGGGCCGGCGCGACCTCGGGC

GCCGGGGGCGGCAGCCGCCTCTACTACAGCTTCAAGAACATCACCAAG

CAGCACCCGCCGCCGCTCGCGCAGCCCGCGCTGTCGCCCGCGTCCTCG

CGCTCGGTGTCCACCTCCTCGTCCAGCAGCAGCGGCAGCAGCAGCGGC

AGCAGCGGCGAGGACGCCGACGACCTGATGTTCGACCTGAGCTTGAAT

TTCTCTCAAAGCGCGCACAGCGCCAGCGAGCAGCAGCTGGGGGGCGGC

GCGGCGGCCGGGAACCTGTCCCTGTCGCTGGTGGATAAGGATTTGGAT

TCGTTCAGCGAGGGCAGCCTGGGCTCCCACTTCGAGTTCCCCGACTAC

TGCACGCCGGAGCTGAGCGAGATGATCGCGGGGGACTGGCTGGAGGCG

AACTTCTCCGACCTGGTGTTCACATAT, or a nucleic acid sequence that hybridizes to a nucleic acid sequence consisting of SEQ ID NO:136 under stringent hybridization conditions.

In some embodiments, SRY-box 12 (SOX12) comprises the amino acid sequence:

(SEQ ID NO: 137; NP_008874)

MVQQRGARAKRDGGPPPPGPGPAEEGAREPGWCKTPSGHIKRPMNAFM

VWSQHERRKIMDQWPDMHNAEISKRLGRRWQLLQDSEKIPFVREAERL

RLKHMADYPDYKYRPRKKSKGAPAKARPRPPGGSGGGSRLKPGPQLPG

RGGRRAAGGPLGGGAAAPEDDDEDDDEELLEVRLVETPGRELWRMVPA

GRAARGQAERAQGPSGEGAAAAAAASPTPSEDEEPEEEEEEAAAAEEG

EEETVASGEESLGFLSRLPPGPAGLDCSALDRDPDLQPPSGTSHFEFP

DYCTPEVTEMIAGDWRPSSIADLVFTY, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:137.

In some embodiments, the nucleic acid sequence encoding SOX12 comprises the nucleic acid sequence:

(SEQ ID NO: 138; NM_006943)

ATGGTGCAGCAGCGGGGCGCGAGGGCCAAGCGGGACGGCGGGCCGCCG

CCCCCGGGACCCGGGCCGGCCGAGGAGGGGGCGCGCGAGCCCGGCTGG

TGCAAGACCCCGAGCGGCCACATCAAGAGGCCGATGAACGCATTCATG

GTGTGGTCGCAGCACGAACGGCGGAAGATCATGGACCAGTGGCCCGAC

ATGCACAACGCCGAGATCTCCAAGCGCCTGGGCCGCCGCTGGCAGCTG

CTGCAGGACTCGGAGAAGATCCCGTTCGTGCGGGAGGCGGAGCGGCTG

CGGCTCAAGCACATGGCGGATTACCCGGACTACAAGTACCGGCCGCGC

AAAAAGAGCAAGGGGGCGCCCGCCAAGGCGCGGCCCCGCCCCCCCGGT

GGTAGCGGTGGCGGCAGCCGGCTCAAGCCCGGGCCGCAGCTGCCTGGC

CGCGGGGGCCGCCGAGCAGCGGGAGGGCCTTTGGGGGGCGGGGCGGCG

GCGCCCGAGGACGACGATGAAGACGACGACGAGGAGCTGCTGGAAGTG

CGCCTGGTCGAGACCCCGGGGCGGGAGCTGTGGAGGATGGTCCCGGCG

-continued

GGACGGGCCGCTCGGGGACAAGCGGAGCGCGCCCAAGGGCCGTCGGGC

GAGGGGGCGGCCGCCGCCGCCGCCGCCTCCCCGACACCGTCGGAGGAC

GAGGAGCCGGAGGAAGAGGAGGAGGAGGCGGCAGCGGCTGAGGAAGGT

GAAGAGGAGACGGTGGCGTCGGGGGAGGAGTCGCTGGGCTTTCTGTCC

AGGCTGCCCCCTGGCCCGGCCGGCCTGGACTGCAGCGCCCTGGATCGC

GACCCGGACCTGCAGCCTCCCTCGGGCACGTCGCACTTCGAGTTCCCG

GACTACTGCACCCCCGAGGTTACCGAGATGATCGCGGGGGACTGGCGC

CCGTCTAGCATCGCAGACCTGGTTTTCACCTAC, or a nucleic acid sequence that hybridizes to a nucleic acid sequence consisting of SEQ ID NO:138 under stringent hybridization conditions.

In some embodiments, SRY-box 5 (SOX5) comprises the amino acid sequence:

(SEQ ID NO: 139; NP_008871)

MLTDPDLPQEFERMSSKRPASPYGEADGEVAMVTSRQKVEEEESDGLP

AFHLPLHVSFPNKPHSEEFQPVSLLTQETCGHRTPTSQHNTMEVDGNK

VMSSFAPHNSSTSPQKAEEGGRQSGESLSSTALGTPERRKGSLADVVD

TLKQRKMEELIKNEPEETPSIEKLLSKDWKDKLLAMGSGNFGEIKGTP

ESLAEKERQLMGMINQLTSLREQLLAAHDEQKKLAASQIEKQRQQMEL

AKQQQEQIARQQQQLLQQQHKINLLQQQIQVQGQLPPLMIPVFPPDQR

TLAAAAQQGFLLPPGFSYKAGCSDPYPVQLIPTTMAAAAAATPGLGPL

QLQQLYAAQLAAMQVSPGGKLPGIPQGNLGAAVSPTSIHTDKSTNSPP

PKSKDEVAQPLNLSAKPKTSDGKSPTSPTSPHMPALRINSGAGPLKAS

VPAALASPSARVSTIGYLNDHDAVTKAIQEARQMKEQLRREQQVLDGK

VAVVNSLGLNNCRTEKEKTTLESLTQQLAVKQNEEGKFSHAMMDFNLS

GDSDGSAGVSESRIYRESRGRGSNEPHIKRPMNAFMVWAKDERRKILQ

AFPDMHNSNISKILGSRWKAMTNLEKQPYYEEQARLSKQHLEKYPDYK

YKPRPKRTCLVDGKKLRIGEYKAIMRNRRQEMRQYFNVGQQAQIPIAT

AGVVYPGAIAMAGMPSPHLPSEHSSVSSSPEPGMPVIQSTYGVKGEEP

HIKEEIQAEDINGEIYDEYDEEEDDPDVDYGSDSENHIAGQAN, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:139.

In some embodiments, the nucleic acid sequence encoding SOX5 comprises the nucleic acid sequence:

(SEQ ID NO: 140; NM_006940)

ATGCTTACTGACCCTGATTTACCTCAGGAGTTTGAAAGGATGTCTTCC

AAGCGACCAGCCTCTCCGTATGGGGAAGCAGATGGAGAGGTAGCCATG

GTGACAAGCAGACAGAAAGTGGAAGAAGAGGAGAGTGACGGGCTCCCA

GCCTTTCACCTTCCCTTGCATGTGAGTTTTCCCAACAAGCCTCACTCT

GAGGAATTTCAGCCAGTTTCTCTGCTGACGCAAGAGACTTGTGGCCAT

AGGACTCCCACTTCTCAGCACAATACAATGGAAGTTGATGGCAATAAA

GTTATGTCTTCATTTGCCCCACACAACTCATCTACCTCACCTCAGAAG

GCAGAAGAAGGTGGGCGACAGAGTGGCGAGTCCTTGTCTAGTACAGCC

CTGGGAACTCCTGAACGGCGCAAGGGCAGTTTAGCTGATGTTGTTGAC

ACCTTGAAGCAGAGGAAAATGGAAGAGCTCATCAAAAACGAGCCGGAA

GAAACCCCCAGTATTGAAAAACTACTCTCAAAGGACTGGAAAGACAAG

CTTCTTGCAATGGGATCGGGGAACTTTGGCGAAATAAAAGGGACTCCC

GAGAGCTTAGCTGAGAAAGAAAGGCAACTCATGGGTATGATCAACCAG

CTGACCAGCCTCCGAGAGCAGCTGTTGGCTGCCCACGATGAGCAGAAG

AAACTAGCTGCCTCTCAGATTGAGAAACAGCGTCAGCAAATGGAGCTG

GCCAAGCAGCAACAAGAACAAATTGCAAGACAGCAGCAGCAGCTTCTA

CAGCAACAACACAAAATCAATTTGCTCCAGCAACAGATCCAGGTTCAA

GGTCAGCTGCCGCCATTAATGATTCCCGTATTCCCTCCTGATCAACGG

ACACTGGCTGCAGCTGCCCAGCAAGGATTCCTCCTCCCTCCAGGCTTC

AGCTATAAGGCTGGATGTAGTGACCCTTACCCTGTTCAGCTGATCCCA

ACTACCATGGCAGCTGCTGCCGCAGCAACACCAGGCTTAGGCCCACTC

CAACTGCAGCAGTTATATGCTGCCCAGCTAGCTGCAATGCAGGTATCT

CCAGGAGGGAAGCTGCCAGGCATACCCCAAGGCAACCTTGGTGCTGCT

GTATCTCCTACCAGCATTCACACAGACAAGAGCACAAACAGCCCACCA

CCCAAAAGCAAGGATGAAGTGGCACAGCCACTGAACCTATCAGCTAAA

CCCAAGACCTCTGATGGCAAATCACCCACATCACCCACCTCTCCCCAT

ATGCCAGCTCTGAGAATAAACAGTGGGGCAGGCCCCCTCAAAGCCTCT

GTCCCAGCAGCGTTAGCTAGTCCTTCAGCCAGAGTTAGCACAATAGGT

TACTTAAATGACCATGATGCTGTCACCAAGGCAATCCAAGAAGCTCGG

CAAATGAAGGAGCAACTCCGACGGGAACAACAGGTGCTTGATGGGAAG

GTGGCTGTTGTGAATAGTCTGGGTCTCAATAACTGCCGAACAGAAAAG

GAAAAAACAACACTGGAGAGTCTGACTCAGCAACTGGCAGTTAAACAG

AATGAAGAAGGAAAATTTAGCCATGCAATGATGGATTTCAATCTGAGT

GGAGATTCTGATGGAAGTGCTGGAGTCTCAGAGTCAAGAATTTATAGG

GAATCCCGAGGGCGTGGTAGCAATGAACCCCACATAAAGCGTCCAATG

AATGCCTTCATGGTGTGGGCTAAAGATGAACGGAGAAAGATCCTTCAA

GCCTTTCCTGACATGCACAACTCCAACATCAGCAAGATATTGGGATCT

CGCTGGAAAGCTATGACAAACCTAGAGAAACAGCCATATTATGAGGAG

CAAGCCCGTCTCAGCAAGCAGCACCTGGAGAAGTACCCTGACTATAAG

TACAAGCCCAGGCCAAAGCGCACCTGCCTGGTGGATGGCAAAAAGCTG

CGCATTGGTGAATACAAGGCAATCATGCGCAACAGGCGGCAGGAAATG

CGGCAGTACTTCAATGTTGGGCAACAAGCACAGATCCCCATTGCCACT

GCTGGTGTTGTGTACCCTGGAGCCATCGCCATGGCTGGGATGCCCTCC

CCTCACCTGCCCTCGGAGCACTCAAGCGTGTCTAGCAGCCCAGAGCCT

GGGATGCCTGTTATCCAGAGCACTTACGGTGTGAAAGGAGAGGAGCCA

CATATCAAAGAAGAGATACAGGCCGAGGACATCAATGGAGAAATTTAT

GATGAGTACGACGAGGAAGAGGATGATCCAGATGTAGATTATGGGAGT

GACAGTGAAAACCATATTGCAGGACAAGCCAAC, or a nucleic acid sequence that hybridizes to a nucleic acid sequence consisting of SEQ ID NO:140 under stringent hybridization conditions.

In some embodiments, SRY-box 6 (SOX6) comprises the amino acid sequence:

(SEQ ID NO: 141; NP_059978)

MGRMSSKQATSPFACAADGEDAMTQDLTSREKEEGSDQHVASHLPLHP

IMHNKPHSEELPTLVSTIQQDADWDSVLSSQQRMESENNKLCSLYSFR

NTSTSPHKPDEGSRDREIMTSVTFGTPERRKGSLADVVDTLKQKKLEE

MTRTEQEDSSCMEKLLSKDWKEKMERLNTSELLGEIKGTPESLAEKER

QLSTMITQLISLREQLLAAHDEQKKLAASQIEKQRQQMDLARQQQEQI

ARQQQQLLQQQHKINLLQQQIQVQGHMPPLMIPIFPHDQRTLAAAAAA

QQGFLFPPGITYKPGDNYPVQFIPSTMAAAAASGLSPLQLQQLYAAQL

ASMQVSPGAKMPSTPQPPNTAGTVSPTGIKNEKRGTSPVTQVKDEAAA

QPLNLSSRPKTAEPVKSPTSPTQNLFPASKTSPVNLPNKSSIPSPIGG

SLGRGSSLGKWKSQHQEETYELDILSSLNSPALFGDQDTVMKAIQEAR

KMREQIQREQQQQQPHGVDGKLSSINNMGLNSCRNEKERTRFENLGPQ

LTGKSNEDGKLGPGVIDLTRPEDAEGSKAMNGSAAKLQQYYCWPTGGA

TVAEARVYRDARGRASSEPHIKRPMNAFMVWAKDERRKILQAFPDMHN

SNISKILGSRWKSMSNQEKQPYYEEQARLSKIHLEKYPNYKYKPRPKR

TCIVDGKKLRIGEYKQLMRSRRQEMRQFFTVGQQPQIPITTGTGVVYP

GAITMATTTPSPQMTSDCSSTSASPEPSLPVIQSTYGMKTDGGSLAGN

EMINGEDEMEMYDDYEDDPKSDYSSENEAPEAVSAN, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:141.

In some embodiments, the nucleic acid sequence encoding SOX6 comprises the nucleic acid sequence:

(SEQ ID NO: 142; NM_017508)

ATGGGAAGAATGTCTTCCAAGCAAGCCACCTCTCCATTTGCCTGTGCA

GCTGATGGAGAGGATGCAATGACCCAGGATTTAACCTCAAGGGAAAAG

GAAGAGGGCAGTGATCAACATGTGGCCTCCCATCTGCCTCTGCACCCC

ATAATGCACAACAAACCTCACTCTGAGGAGCTACCAACACTTGTCAGT

ACCATTCAACAAGATGCTGACTGGGACAGCGTTCTGTCATCTCAGCAA

AGAATGGAATCAGAGAATAATAAGTTATGTTCCCTATATTCCTTCCGA

AATACCTCTACCTCACCACATAAGCCTGACGAAGGGAGTCGGGACCGT

GAGATAATGACCAGTGTTACTTTTGGAACCCCAGAGCGCCGCAAAGGG

AGTCTTGCCGATGTGGTGGACACACTGAAACAGAAGAAGCTTGAGGAA

ATGACTCGGACTGAACAAGAGGATTCCTCCTGCATGGAAAAACTACTT

TCAAAAGATTGGAAGGAAAAAATGGAAAGACTAAATACCAGTGAACTT

-continued

CTTGGAGAAATTAAAGGTACACCTGAGAGCCTGGCAGAAAAAGAACGG

CAGCTCTCCACCATGATTACCCAGCTGATCAGTTTACGGGAGCAGCTA

CTGGCAGCGCATGATGAACAGAAAAAACTGGCAGCGTCACAAATTGAG

AAACAACGGCAGCAAATGGACCTTGCTCGCCAACAGCAAGAACAGATT

GCGAGACAACAGCAGCAACTTCTGCAACAGCAGCACAAAATTAATCTC

CTGCAGCAACAGATCCAGGTTCAGGGTCACATGCCTCCGCTCATGATC

CCAATTTTTCCACATGACCAGCGGACTCTGGCAGCAGCTGCTGCTGCC

CAACAGGGATTCCTCTTCCCCCCTGGAATAACATACAAACCAGGTGAT

AACTACCCCGTACAGTTCATTCCATCAACAATGGCAGCTGCTGCTGCT

TCTGGACTCAGCCCTTTACAGCTCCAGCAGCTCTATGCCGCTCAGCTG

GCCAGCATGCAGGTGTCACCTGGAGCAAAGATGCCATCAACTCCACAG

CCACCAAACACAGCAGGGACGGTCTCACCTACTGGGATAAAAAATGAA

AAGAGAGGGACCAGCCCTGTAACTCAAGTTAAGGATGAAGCAGCAGCA

CAGCCTCTGAATCTCTCATCCCGACCCAAGACAGCAGAGCCTGTAAAG

TCCCCAACGTCTCCCACCCAGAACCTCTTCCCAGCCAGCAAAACCAGC

CCTGTCAATCTGCCAAACAAAAGCAGCATCCCTAGCCCCATTGGAGGA

AGCCTGGGAAGAGGATCCTCTTTAGGTAAATGGAAAAGTCAACACCAG

GAAGAGACTTACGAATTAGATATCCTATCTAGTCTCAACTCCCCTGCC

CTTTTTGGGGATCAGGATACAGTGATGAAAGCCATTCAGGAGGCGCGG

AAGATGCGAGAGCAGATCCAGCGGGAGCAACAGCAGCAACAGCCACAT

GGTGTTGACGGGAAACTGTCCTCCATAAATAATATGGGGCTGAACAGC

TGCAGGAATGAAAAGGAAAGAACGCGCTTTGAGAATTTGGGGCCCCAG

TTAACGGGAAAGTCAAATGAAGATGGAAAACTGGGCCCAGGTGTCATC

GACCTTACTCGGCCAGAAGATGCAGAGGGAAGTAAAGCAATGAATGGC

TCTGCAGCTAAACTACAGCAGTATTATTGTTGGCCAACAGGAGGTGCC

ACTGTGGCTGAAGCACGAGTCTACAGGGACGCCCGCGGCCGTGCCAGC

AGCGAGCCACACATTAAGCGACCAATGAATGCATTCATGGTTTGGGCA

AAGGATGAGAGGAGAAAAATCCTTCAGGCCTTCCCCGACATGCATAAC

TCCAACATTAGCAAAATCTTAGGATCTCGCTGGAAATCAATGTCCAAC

CAGGAGAAGCAACCTTATTATGAAGAGCAGGCCCGGCTAAGCAAGATC

CACTTAGAGAAGTACCCAAACTATAAATACAAACCCCGACCGAAACGC

ACCTGCATTGTTGATGGCAAAAAGCTTCGGATTGGGGAGTATAAGCAA

CTGATGAGGTCTCGGAGACAGGAGATGAGGCAGTTCTTTACTGTGGGG

CAACAGCCTCAGATTCCAATCACCACAGGAACAGGTGTTGTGTATCCT

GGTGCTATCACTATGGCAACTACCACACCATCGCCTCAGATGACATCT

GACTGCTCTAGCACCTCGGCCAGCCCGGAGCCCAGCCTCCCGGTCATC

CAGAGCACTTATGGTATGAAGACAGATGGCGGAAGCCTAGCTGGAAAT

GAAATGATCAATGGAGAGGATGAAATGGAAATGTATGATGACTATGAA

GATGACCCCAAATCAGACTATAGCAGTGAAAATGAAGCCCCGGAGGCT

GTCAGTGCCAAC, or a nucleic acid sequence that hybridizes to a nucleic acid sequence consisting of SEQ ID NO:142 under stringent hybridization conditions.

In some embodiments, SRY-box 13 (SOX13) comprises the amino acid sequence:

(SEQ ID NO: 143; NP_005677)

MSMRSPISAQLALDGVGTMVNCTIKSEEKKEPCHEAPQGSATAAEPQP

GDPARASQDSADPQAPAQGNFRGSWDCSSPEGNGSPEPKRPGVSEAAS

GSQEKLDFNRNLKEVVPAIEKLLSSDWKERFLGRNSMEAKDVKGTQES

LAEKELQLLVMIHQLSTLRDQLLTAHSEQKNMAAMLFEKQQQQMELAR

QQQEQIAKQQQQLIQQQHKINLLQQQIQQVNMPYVMIPAFPPSHQPLP

VTPDSQLALPIQPIPCKPVEYPLQLLHSPPAPVVKRPGAMATHHPLQE

PSQPLNLTAKPKAPELPNTSSSPSLKMSSCVPRPPSHGGPTRDLQSSP

PSLPLGFLGEGDAVTKAIQDARQLLHSHSGALDGSPNTPFRKDLISLD

SSPAKERLEDGCVHPLEEAMLSCDMDGSRHFPESRNSSHIKRPMNAFM

VWAKDERRKILQAFPDMHNSSISKILGSRWKSMTNQEKQPYYEEQARL

SRQHLEKYPDYKYKPRPKRTCIVEGKRLRVGEYKALMRTRRQDARQSY

VIPPQAGQVQMSSSDVLYPRAAGMPLAQPLVEHYVPRSLDPNMPVIVN

TCSLREEGEGTDDRHSVADGEMYRYSEDEDSEGEEKSDGELVVLTD, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:143.

In some embodiments, the nucleic acid sequence encoding SOX13 comprises the nucleic acid sequence:

(SEQ ID NO: 144; NM_005686)

ATGTCCATGAGGAGCCCCATCTCTGCCCAGCTGGCCCTGGATGGCGTT

GGCACCATGGTGAACTGCACCATCAAGTCAGAGGAGAAGAAAGAGCCT

TGCCACGAGGCCCCCCAGGGCTCAGCCACTGCCGCTGAACCTCAGCCT

GGAGACCCAGCCCGGGCCTCCCAGGATAGTGCTGACCCCCAAGCTCCA

GCCCAGGGGAATTTCAGGGGCTCCTGGGACTGTAGCTCTCCAGAGGGT

AATGGGTCCCCAGAACCCAAGAGACCAGGAGTGTCGGAGGCTGCCTCT

GGAAGCCAGGAGAAGCTGGACTTCAACCGAAATTTGAAAGAAGTGGTG

CCAGCCATAGAGAAGCTGTTGTCCAGTGACTGGAAGGAGAGGTTTCTA

GGAAGGAACTCTATGGAAGCCAAAGATGTCAAAGGGACCCAAGAGAGC

CTAGCAGAGAAGGAGCTCCAGCTTCTGGTCATGATTCACCAGCTGTCC

ACCCTGCGGGACCAGCTCCTGACAGCCCACTCGGAGCAGAAGAACATG

GCTGCCATGCTGTTTGAGAAGCAGCAGCAGCAGATGGAGCTTGCCCGG

CAGCAGCAGGAGCAGATTGCAAAGCAGCAGCAGCAGCTGATTCAGCAG

CAGCATAAGATCAACCTCCTTCAGCAGCAGATCCAGCAGGTTAACATG

CCTTATGTCATGATCCCAGCCTTCCCCCCAAGCCACCAACCTCTGCCT

GTCACCCCTGACTCCCAGCTGGCCTTACCCATTCAGCCCATTCCCTGC

AAACCAGTGGAGTATCCGCTGCAGCTGCTGCACAGCCCCCCTGCCCCA

GTGGTGAAGAGGCCTGGGGCCATGGCCACCCACCACCCCCTGCAGGAG

-continued

CCCTCCCAGCCCCTGAACCTCACAGCCAAGCCCAAGGCCCCCGAGCTG

CCCAACACCTCCAGCTCCCCAAGCCTGAAGATGAGCAGCTGTGTGCCC

CGCCCCCCCAGCCATGGAGGCCCCACGCGGGACCTGCAGTCCAGCCCC

CCGAGCCTGCCTCTGGGCTTCCTTGGTGAAGGGGACGCTGTCACCAAA

GCCATCCAGGATGCTCGGCAGCTGCTGCACAGCCACAGTGGGGCCTTG

GATGGCTCCCCCAACACCCCCTTCCGTAAGGACCTCATCAGCCTGGAC

TCATCCCCAGCCAAGGAGCGGCTGGAGGACGGCTGTGTGCACCCACTG

GAGGAAGCCATGCTGAGCTGCGACATGGATGGCTCCCGCCACTTCCCC

GAGTCCCGAAACAGCAGCCACATCAAGAGGCCCATGAACGCCTTCATG

GTGTGGGCCAAGGATGAGCGGAGGAAGATCCTGCAAGCCTTCCCAGAC

ATGCACAACTCCAGCATCAGCAAGATCCTTGGATCTCGCTGGAAGTCC

ATGACCAACCAGGAGAAGCAGCCCTACTATGAGGAACAGGCGCGGCTG

AGCCGGCAGCACCTGGAGAAGTATCCTGACTACAAGTACAAGCCGCGG

CCCAAGCGCACCTGCATCGTGGAGGGCAAGCGGCTGCGCGTGGGAGAG

TACAAGGCCCTGATGAGGACCCGGCGTCAGGATGCCCGCCAGAGCTAC

GTGATCCCCCCGCAGGCTGGCCAGGTGCAGATGAGCTCCTCAGATGTC

CTGTACCCTCGGGCAGCAGGCATGCCGCTGGCACAGCCACTGGTGGAG

CACTATGTCCCTCGTAGCCTGGACCCCAACATGCCTGTGATCGTCAAC

ACCTGCAGCCTCAGAGAGGAGGGTGAGGGCACAGATGACAGGCACTCG

GTGGCTGATGGCGAGATGTACCGGTACAGCGAGGACGAGGACTCGGAG

GGCGAAGAGAAGAGCGATGGGGAGTTGGTGGTGCTCACAGAC, or a nucleic acid sequence that hybridizes to a nucleic acid sequence consisting of SEQ ID NO:144 under stringent hybridization conditions.

In some embodiments, SRY-box 8 (SOX8) comprises the amino acid sequence:

(SEQ ID NO: 145; NP_055402)

MLDMSEARSQPPCSPSGTASSMSHVEDSDSDAPPSPAGSEGLGRAGVA

VGGARGDPAEAADERFPACIRDAVSQVLKGYDWSLVPMPVRGGGGGAL

KAKPHVKRPMNAFMVWAQAARRKLADQYPHLHNAELSKTLGKLWRLLS

ESEKRPFVEEAERLRVQHKKDHPDYKYQPRRRKSAKAGHSDSDSGAEL

GPHPGGGAVYKAEAGLGDGHHHGDHTGQTHGPPTPPTTPKTELQQAGA

KPELKLEGRRPVDSGRQNIDFSNVDISELSSEVMGTMDAFDVHEFDQY

LPLGGPAPPEPGQAYGGAYFHAGASPVWAHKSAPSASASPTETGPPRP

HIKTEQPSPGHYGDQPRGSPDYGSCSGQSSATPAAPAGPFAGSQGDYG

DLQASSYYGAYPGYAPGLYQYPCFHSPRRPYASPLLNGLALPPAHSPT

SHWDQPVYTTLTRP, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:145.

In some embodiments, the nucleic acid sequence encoding SOX8 comprises the nucleic acid sequence (SEQ ID NO: 146; NM_014587)

ATGCTGGACATGAGCGAGGCCCGCTCCCAGCCGCCCTGCAGCCCGTCC

GGCACCGCCAGCTCCATGTCGCACGTGGAGGACTCGGACTCGGACGCG

CCGCCGTCTCCCGCCGGCTCCGAGGGCCTGGGCCGCGCGGGGGTCGCG

GTGGGGGGCGCCCGGGGCGACCCGGCGGAGGCGGCGGACGAGCGCTTC

CCGGCCTGCATCCGCGACGCCGTGTCGCAGGTGCTCAAGGGCTACGAC

TGGAGTCTGGTGCCCATGCCGGTGCGCGGCGGCGGCGGCGGCGCGCTC

AAAGCCAAGCCGCATGTGAAGCGGCCCATGAACGCATTCATGGTGTGG

GCGCAGGCGGCGCGCCGCAAGCTGGCCGACCAGTACCCGCACCTGCAC

AACGCCGAGCTCAGCAAGACGCTGGGCAAGCTGTGGCGCTTGCTGAGC

GAGAGCGAGAAGCGGCCCTTCGTGGAGGAGGCAGAGCGCCTTCGCGTG

CAGCACAAGAAGGACCACCCCGACTACAAGTACCAGCCACGGCGCAGG

AAGAGCGCCAAAGCCGGCCACAGCGACTCCGACTCGGGCGCGGAGCTG

GGACCCCACCCTGGCGGCGGTGCCGTGTACAAGGCTGAAGCAGGGCTT

GGAGATGGGCACCACCATGGCGACCACACAGGGCAGACCCACGGGCCG

CCCACCCCGCCCACCACCCCCAAGACGGAGCTGCAGCAGGCGGGCGCC

AAGCCGGAGCTGAAGCTGGAGGGACGCCGGCCGGTGGACAGCGGGCGC

CAGAACATCGACTTCAGCAATGTGGACATCTCGGAGCTCAGCAGCGAG

GTCATGGGCACCATGGACGCCTTCGACGTCCACGAGTTCGACCAGTAC

CTGCCCCTGGGCGGCCCCGCCCCACCCGAGCCGGGCCAGGCCTATGGG

GGCGCCTACTTCCACGCCGGGGCGTCCCCCGTGTGGGCCCACAAGAGT

GCCCCGTCGGCCTCCGCGTCGCCCACCGAGACGGGTCCCCCACGGCCG

CACATCAAGACGGAGCAGCCGAGCCCCGGCCACTACGGCGACCAGCCC

CGAGGCTCGCCCGACTACGGTTCCTGCAGCGGCCAGTCCAGCGCCACC

CCGGCCGCCCCCGCCGGCCCCTTCGCCGGCTCACAGGGCGACTATGGC

GACCTGCAGGCCTCCAGCTACTATGGTGCCTACCCTGGCTACGCACCC

GGCCTCTACCAGTACCCCTGCTTCCACTCGCCGCGCCGGCCCTACGCC

TCACCCCTGCTCAACGGCCTGGCCCTGCCGCCCGCCCACAGCCCCACC

AGTCACTGGGACCAGCCGGTGTACACCACCCTGACCAGGCCC, or a nucleic acid sequence that hybridizes to a nucleic acid sequence consisting of SEQ ID NO:146 under stringent hybridization conditions.

In some embodiments, SRY-box 9 (SOX9) comprises the amino acid sequence:

(SEQ ID NO: 147; NP_000337)

MNLLDPFMKMTDEQEKGLSGAPSPTMSEDSAGSPCPSGSGSDTENTRPQ

ENTFPKGEPDLKKESEEDKFPVCIREAVSQVLKGYDWTLVPMPVRVNGS

SKNKPHVKRPMNAFMVWAQAARRKLADQYPHLHNAELSKTLGKLWRLLN

ESEKRPFVEEAERLRVQHKKDHPDYKYQPRRRKSVKNGQAEAEEATEQT

HISPNAIFKALQADSPHSSSGMSEVHSPGEHSGQSQGPPTPPTTPKTDV

QPGKADLKREGRPLPEGGRQPPIDFRDVDIGELSSDVISNIETFDVNEF

-continued

DQYLPPNGHPGVPATHGQVTYTGSYGISSTAATPASAGHVWMSKQQAPP

PPPQQPPQAPPAPQAPPQPQAAPPQQPAAPPQQPQAHTLTTLSSEPGQS

QRTHIKTEQLSPSHYSEQQQHSPQQIAYSPFNLPHYSPSYPPITRSQYD

YTDHQNSSSYYSHAAGQGTGLYSTFTYMNPAQRPMYTPIADTSGVPSIP

QTHSPQHWEQPVYTQLTRP, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:147.

In some embodiments, the nucleic acid sequence encoding SOX9 comprises the nucleic acid sequence:

(SEQ ID NO: 148; NM_000346)

ATGAATCTCCTGGACCCCTTCATGAAGATGACCGACGAGCAGGAGAAGG

GCCTGTCCGGCGCCCCCAGCCCCACCATGTCCGAGGACTCCGCGGGCTC

GCCCTGCCCGTCGGGCTCCGGCTCGGACACCGAGAACACGCGGCCCCAG

GAGAACACGTTCCCCAAGGGCGAGCCCGATCTGAAGAAGGAGAGCGAGG

AGGACAAGTTCCCCGTGTGCATCCGCGAGGCGGTCAGCCAGGTGCTCAA

AGGCTACGACTGGACGCTGGTGCCCATGCCGGTGCGCGTCAACGGCTCC

AGCAAGAACAAGCCGCACGTCAAGCGGCCCATGAACGCCTTCATGGTGT

GGGCGCAGGCGGCGCGCAGGAAGCTCGCGGACCAGTACCCGCACTTGCA

CAACGCCGAGCTCAGCAAGACGCTGGGCAAGCTCTGGAGACTTCTGAAC

GAGAGCGAGAAGCGGCCCTTCGTGGAGGAGGCGGAGCGGCTGCGCGTGC

AGCACAAGAAGGACCACCCGGATTACAAGTACCAGCCGCGGCGGAGGAA

GTCGGTGAAGAACGGGCAGGCGGAGGCAGAGGAGGCCACGGAGCAGACG

CACATCTCCCCCAACGCCATCTTCAAGGCGCTGCAGGCCGACTCGCCAC

ACTCCTCCTCCGGCATGAGCGAGGTGCACTCCCCCGGCGAGCACTCGGG

GCAATCCCAGGGCCCACCGACCCCACCCACCACCCCCAAAACCGACGTG

CAGCCGGGCAAGGCTGACCTGAAGCGAGAGGGGCGCCCCTTGCCAGAGG

GGGGCAGACAGCCCCCTATCGACTTCCGCGACGTGGACATCGGCGAGCT

GAGCAGCGACGTCATCTCCAACATCGAGACCTTCGATGTCAACGAGTTT

GACCAGTACCTGCCGCCCAACGGCCACCCGGGGGTGCCGGCCACGCACG

GCCAGGTCACCTACACGGGCAGCTACGGCATCAGCAGCACCGCGGCCAC

CCCGGCGAGCGCGGGCCACGTGTGGATGTCCAAGCAGCAGGCGCCGCCG

CCACCCCCGCAGCAGCCCCCACAGGCCCCGCCGGCCCCGCAGGCGCCCC

CGCAGCCGCAGGCGGCGCCCCCACAGCAGCCGGCGGCACCCCCGCAGCA

GCCACAGGCGCACACGCTGACCACGCTGAGCAGCGAGCCGGGCCAGTCC

CAGCGAACGCACATCAAGACGGAGCAGCTGAGCCCCAGCCACTACAGCG

AGCAGCAGCAGCACTCGCCCCAACAGATCGCCTACAGCCCCTTCAACCT

CCCACACTACAGCCCCTCCTACCCGCCCATCACCCGCTCACAGTACGAC

TACACCGACCACCAGAACTCCAGCTCCTACTACAGCCACGCGGCAGGCC

AGGGCACCGGCCTCTACTCCACCTTCACCTACATGAACCCCGCTCAGCG

-continued

CCCCATGTACACCCCCATCGCCGACACCTCTGGGGTCCCTTCCATCCCG

CAGACCCACAGCCCCCAGCACTGGGAACAACCCGTCTACACACAGCTCA

CTCGACCT, or a nucleic acid sequence that hybridizes to a nucleic acid sequence consisting of SEQ ID NO:148 under stringent hybridization conditions.

In some embodiments, SRY-box 10 (SOX10) comprises the amino acid sequence:

(SEQ ID NO: 149; NP_008872)

MAEEQDLSEVELSPVGSEEPRCLSPGSAPSLGPDGGGGGSGLRASPGPG

ELGKVKKEQQDGEADDDKFPVCIREAVSQVLSGYDWTLVPMPVRVNGAS

KSKPHVKRPMNAFMVWAQAARRKLADQYPHLHNAELSKTLGKLWRLLNE

SDKRPFIEEAERLRMQHKKDHPDYKYQPRRRKNGKAAQGEAECPGGEAE

QGGTAAIQAHYKSAHLDHRHPGEGSPMSDGNPEHPSGQSHGPPTPPTTP

KTELQSGKADPKRDGRSMGEGGKPHIDFGNVDIGEISHEVMSNMETFDV

AELDQYLPPNGHPGHVSSYSAAGYGLGSALAVASGHSAWISKPPGVALP

TVSPPGVDAKAQVKTETAGPQGPPHYTDQPSTSQIAYTSLSLPHYGSAF

PSISRPQFDYSDHQPSGPYYGHSGQASGLYSAFSYMGPSQRPLYTAISD

PSPSGPQSHSPTHWEQPVYTTLSRP, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:149.

In some embodiments, the nucleic acid sequence encoding SOX10 comprises the nucleic acid sequence:

(SEQ ID NO: 150; NM_006941)

ATGGCGGAGGAGCAGGACCTATCGGAGGTGGAGCTGAGCCCCGTGGGCT

CGGAGGAGCCCCGCTGCCTGTCCCCGGGGAGCGCGCCCTCGCTAGGGCC

CGACGGCGGCGGCGGCGGATCGGGCCTGCGAGCCAGCCCGGGGCCAGGC

GAGCTGGGCAAGGTCAAGAAGGAGCAGCAGGACGGCGAGGCGGACGATG

ACAAGTTCCCCGTGTGCATCCGCGAGGCCGTCAGCCAGGTGCTCAGCGG

CTACGACTGGACGCTGGTGCCCATGCCCGTGCGCGTCAACGGCGCCAGC

AAAAGCAAGCCGCACGTCAAGCGGCCCATGAACGCCTTCATGGTGTGGG

CTCAGGCAGCGCGCAGGAAGCTCGCGGACCAGTACCCGCACCTGCACAA

CGCTGAGCTCAGCAAGACGCTGGGCAAGCTCTGGAGGCTGCTGAACGAA

AGTGACAAGCGCCCCTTCATCGAGGAGGCTGAGCGGCTCCGTATGCAGC

ACAAGAAAGACCACCCGGACTACAAGTACCAGCCCAGGCGGCGGAAGAA

CGGGAAGGCCGCCCAGGGCGAGGCGGAGTGCCCCGGTGGGGAGGCCGAG

CAAGGTGGGACCGCCGCCATCCAGGCCCACTACAAGAGCGCCCACTTGG

ACCACCGGCACCCAGGAGAGGGCTCCCCCATGTCAGATGGTAACCCCGA

GCACCCCTCAGGCCAGAGCCATGGCCCACCCACCCCTCCAACCACCCCG

AAGACAGAGCTGCAGTCGGGCAAGGCAGACCCGAAGCGGGACGGGCGCT

CCATGGGGGAGGGCGGGAAGCCTCACATCGACTTCGGCAACGTGGACAT

-continued

TGGTGAGATCAGCCACGAGGTAATGTCCAACATGGAGACCTTTGATGTG

GCTGAGTTGGACCAGTACCTGCCGCCCAATGGGCACCCAGGCCATGTGA

GCAGCTACTCAGCAGCCGGCTATGGGCTGGGCAGTGCCCTGGCCGTGGC

CAGTGGACACTCCGCCTGGATCTCCAAGCCACCAGGCGTGGCTCTGCCC

ACGGTCTCACCACCTGGTGTGGATGCCAAAGCCCAGGTGAAGACAGAGA

CCGCGGGGCCCCAGGGGCCCCCACACTACACCGACCAGCCATCCACCTC

ACAGATCGCCTACACCTCCCTCAGCCTGCCCCACTATGGCTCAGCCTTC

CCCTCCATCTCCCGCCCCCAGTTTGACTACTCTGACCATCAGCCCTCAG

GACCCTATTATGGCCACTCGGGCCAGGCCTCTGGCCTCTACTCGGCCTT

CTCCTATATGGGGCCCTCGCAGCGGCCCCTCTACACGGCCATCTCTGAC

CCCAGCCCCTCAGGGCCCCAGTCCCACAGCCCCACACACTGGGAGCAGC

CAGTATATACGACACTGTCCCGGCCC, or a nucleic acid sequence that hybridizes to a nucleic acid sequence consisting of SEQ ID NO:150 under stringent hybridization conditions.

In some embodiments, SRY-box 7 (SOX7) comprises the amino acid sequence:

(SEQ ID NO: 151; NP_113627)

MASLLGAYPWPEGLECPALDAELSDGQSPPAVPRPPGDKGSESRIRRPM

NAFMVWAKDERKRLAVQNPDLHNAELSKMLGKSWKALTLSQKRPYVDEA

ERLRLQHMQDYPNYKYRPRRKKQAKRLCKRVDPGFLLSSLSRDQNALPE

KRSGSRGALGEKEDRGEYSPGTALPSLRGCYHEGPAGGGGGGTPSSVDT

YPYGLPTPPEMSPLDVLEPEQTFFSSPCQEEHGHPRRIPHLPGHPYSPE

YAPSPLHCSHPLGSLALGQSPGVSMMSPVPGCPPSPAYYSPATYHPLHS

NLQAHLGQLSPPPEHPGFDALDQLSQVELLGDMDRNEFDQYLNTPGHPD

SATGAMALSGHVPVSQVTPTGPTETSLISVLADATATYYNSYSVS, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:151.

In some embodiments, the nucleic acid sequence encoding SOX7 comprises the nucleic acid sequence:

(SEQ ID NO: 152; NM_031439)

ATGGCTTCGCTGCTGGGAGCCTACCCTTGGCCCGAGGGTCTCGAGTGCC

CGGCCCTGGACGCCGAGCTGTCGGATGGACAATCGCCGCCGGCCGTCCC

CCGGCCCCCGGGGGACAAGGGCTCCGAGAGCCGTATCCGGCGGCCCATG

AACGCCTTCATGGTTTGGGCCAAGGACGAGAGGAAACGGCTGGCAGTGC

AGAACCCGGACCTGCACAACGCCGAGCTCAGCAAGATGCTGGGAAAGTC

GTGGAAGGCGCTGACGCTGTCCCAGAAGAGGCCGTACGTGGACGAGGCG

GAGCGGCTGCGCCTGCAGCACATGCAGGACTACCCCAACTACAAGTACC

GGCCGCGCAGGAAGAAGCAGGCCAAGCGGCTGTGCAAGCGCGTGGACCC

GGGCTTCCTTCTGAGCTCCCTCTCCCGGGACCAGAACGCCCTGCCGGAG

-continued

AAGAGAAGCGGCAGCCGGGGGGCGCTGGGGGAGAAGGAGGACAGGGGTG

AGTACTCCCCCGGCACTGCCCTGCCCAGCCTCCGGGGCTGCTACCACGA

GGGGCCGGCTGGTGGTGGCGGCGGCGGCACCCCGAGCAGTGTGGACACG

TACCCGTACGGGCTGCCCACACCTCCTGAAATGTCTCCCCTGGACGTGC

TGGAGCCGGAGCAGACCTTCTTCTCCTCCCCCTGCCAGGAGGAGCATGG

CCATCCCCGCCGCATCCCCCACCTGCCAGGGCACCCGTACTCACCGGAG

TACGCCCCAAGCCCTCTCCACTGTAGCCACCCCCTGGGCTCCCTGGCCC

TTGGCCAGTCCCCCGGCGTCTCCATGATGTCCCCTGTACCCGGCTGTCC

CCCATCTCCTGCCTATTACTCCCCGGCCACCTACCACCCACTCCACTCC

AACCTCCAAGCCCACCTGGGCCAGCTTTCCCCGCCTCCTGAGCACCCTG

GCTTCGACGCCCTGGATCAACTGAGCCAGGTGGAACTCCTGGGGGACAT

GGATCGCAATGAATTCGACCAGTATTTGAACACTCCTGGCCACCCAGAC

TCCGCCACAGGGGCCATGGCCCTCAGTGGGCATGTTCCGGTCTCCCAGG

TGACACCAACGGGTCCCACAGAGACCAGCCTCATCTCCGTCCTGGCTGA

TGCCACGGCCACGTACTACAACAGCTACAGTGTGTCA, or a nucleic acid sequence that hybridizes to a nucleic acid sequence consisting of SEQ ID NO:152 under stringent hybridization conditions.

In some embodiments, SRY-box 17 (SOX17) comprises the amino acid sequence:

(SEQ ID NO: 153; NP_071899)

MSSPDAGYASDDQSQTQSALPAVMAGLGPCPWAESLSPIGDMKVKGEAP

ANSGAPAGAAGRAKGESRIRRPMNAFMVWAKDERKRLAQQNPDLHNAEL

SKMLGKSWKALTLAEKRPFVEEAERLRVQHMQDHPNYKYRPRRRKQVKR

LKRVEGGFLHGLAEPQAAALGPEGGRVAMDGLGLQFPEQGFPAGPPLLP

PHMGGHYRDCQSLGAPPLDGYPLPTPDTSPLDGVDPDPAFFAAPMPGDC

PAAGTYSYAQVSDYAGPPEPPAGPMHPRLGPEPAGPSIPGLLAPPSALH

VYYGAMGSPGAGGGRGFQMQPQHQHQHQHQHHPPGPGQPSPPPEALPCR

DGTDPSQPAELLGEVDRTEFEQYLHFVCKPEMGLPYQGHDSGVNLPDSH

GAISSVVSDASSAVYYCNYPDV, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:153.

In some embodiments, the nucleic acid sequence encoding SOX17 comprises the nucleic acid sequence:

(SEQ ID NO: 154; NM_022454)

ATGAGCAGCCCGGATGCGGGATACGCCAGTGACGACCAGAGCCAGACCC

AGAGCGCGCTGCCCGCGGTGATGGCCGGGCTGGGCCCCTGCCCCTGGGC

CGAGTCGCTGAGCCCCATCGGGGACATGAAGGTGAAGGGCGAGGCGCCG

GCGAACAGCGGAGCACCGGCCGGGGCCGCGGGCCGAGCCAAGGGCGAGT

CCCGTATCCGGCGGCCGATGAACGCTTTCATGGTGTGGGCTAAGGACGA

GCGCAAGCGGCTGGCGCAGCAGAATCCAGACCTGCACAACGCCGAGTTG

-continued

AGCAAGATGCTGGGCAAGTCGTGGAAGGCGCTGACGCTGGCGGAGAAGC
GGCCCTTCGTGGAGGAGGCAGAGCGGCTGCGCGTGCAGCACATGCAGGA
CCACCCCAACTACAAGTACCGGCCGCGGCGGCGCAAGCAGGTGAAGCGG
CTGAAGCGGGTGGAGGGCGGCTTCCTGCACGGCCTGGCTGAGCCGCAGG
CGGCCGCGCTGGGCCCCGAGGGCGGCCGCGTGGCCATGGACGGCCTGGG
CCTCCAGTTCCCCGAGCAGGGCTTCCCCGCCGGCCCGCCGCTGCTGCCT
CCGCACATGGGCGGCCACTACCGCGACTGCCAGAGTCTGGGCGCGCCTC
CGCTCGACGGCTACCCGTTGCCCACGCCCGACACGTCCCCGCTGGACGG
CGTGGACCCCGACCCGGCTTTCTTCGCCGCCCCGATGCCCGGGGACTGC
CCGGCGGCCGGCACCTACAGCTACGCGCAGGTCTCGGACTACGCTGGCC
CCCCGGAGCCTCCCGCCGGTCCCATGCACCCCCGACTCGGCCCAGAGCC
CGCGGGTCCCTCGATTCCGGGCCTCCTGGCGCCACCCAGCGCCCTTCAC
GTGTACTACGGCGCGATGGGCTCGCCCGGGGCGGGCGGCGGGCGCGGCT
TCCAGATGCAGCCGCAACACCAGCACCAGCACCAGCACCAGCACCACCC
CCCGGGCCCCGGACAGCCGTCGCCCCCTCCGGAGGCACTGCCCTGCCGG
GACGGCACGGACCCCAGTCAGCCCGCCGAGCTCCTCGGGGAGGTGGACC
GCACGGAATTTGAACAGTATCTGCACTTCGTGTGCAAGCCTGAGATGGG
CCTCCCCTACCAGGGGCATGACTCCGGTGTGAATCTCCCCGACAGCCAC
GGGGCCATTTCCTCGGTGGTGTCCGACGCCAGCTCCGCGGTATATTACT
GCAACTATCCTGACGTG, or a nucleic acid sequence that hybridizes to a nucleic acid sequence consisting of SEQ ID NO:154 under stringent hybridization conditions.

In some embodiments, SRY-box 18 (SOX18) comprises the amino acid sequence:

(SEQ ID NO: 155; NP_060889)
MQRSPPGYGAQDDPPARRDCAWAPGHGAAADTRGLAAGPAALAAPAAPA
SPPSPQRSPPRSPEPGRYGLSPAGRGERQAADESRIRRPMNAFMVWAKD
ERKRLAQQNPDLHNAVLSKMLGKAWKELNAAEKRPFVEEAERLRVQHLR
DHPNYKYRPRRKKQARKARRLEPGLLLPGLAPPQPPPEPFPAASGSARA
FRELPPLGAEFDGLGLPTPERSPLDGLEPGEAAFFPPPAAPEDCALRPF
RAPYAPTELSRDPGGCYGAPLAEALRTAPPAAPLAGLYYGTLGTPGPYP
GPLSPPPEAPPLESAEPLGPAADLWADVDLTEFDQYLNCSRTRPDAPGL
PYHVALAKLGPRAMSCPEESSLISALSDASSAVYYSACISGSGP, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:155.

In some embodiments, the nucleic acid sequence encoding SOX18 comprises the nucleic acid sequence:

(SEQ ID NO: 156; NM_018419)
ATGCAGAGATCGCCGCCCGGCTACGGCGCACAGGACGACCCGCCCGCCC
GCCGCGACTGTGCATGGGCCCCGGGACACGGGGCCGCCGCTGACACGCG
CGGCCTCGCCGCCGGCCCCGCCGCCCTCGCCGCGCCCGCCGCGCCCGCC
TCGCCGCCCAGCCCGCAGCGCAGTCCCCCGCGCAGCCCCGAGCCGGGGC
GCTATGGCCTCAGCCCGGCCGGCCGCGGGGAACGCCAGGCGGCAGACGA
GTCGCGCATCCGGCGGCCCATGAACGCCTTCATGGTGTGGGCAAAGGAC
GAGCGCAAGCGGCTGGCTCAGCAGAACCCGGACCTGCACAACGCGGTGC
TCAGCAAGATGCTGGGCAAAGCGTGGAAGGAGCTGAACGCGGCGGAGAA
GCGGCCCTTCGTGGAGGAAGCCGAACGGCTGCGCGTGCAGCACTTGCGC
GACCACCCCAACTACAAGTACCGGCCGCGCCGCAAGAAGCAGGCGCGCA
AGGCCCGGCGGCTGGAGCCCGGCCTCCTGCTCCCGGGATTAGCGCCCCC
GCAGCCACCGCCCGAGCCTTTCCCCGCGGCGTCTGGCTCGGCTCGCGCC
TTCCGCGAGCTGCCCCCGCTGGGCGCCGAGTTCGACGGCCTGGGGCTGC
CCACGCCCGAGCGCTCGCCTCTGGACGGCCTGGAGCCCGGCGAGGCTGC
CTTCTTCCCACCGCCCGCGGCGCCCGAGGACTGCGCGCTGCGGCCCTTC
CGCGCGCCCTACGCGCCCACCGAGTTGTCGCGGGACCCCGGCGGTTGCT
ACGGGGCTCCCCTGGCGGAGGCGCTCAGGACCGCGCCCCCCGCGGCGCC
GCTCGCTGGCCTGTACTACGGCACCCTGGGCACGCCCGGCCCGTACCCC
GGCCCGCTGTCGCCGCCGCCCGAGGCCCCGCCGCTGGAGAGCGCCGAGC
CGCTGGGGCCCGCCGCCGATCTGTGGGCCGACGTGGACCTCACCGAGTT
CGACCAGTACCTCAACTGCAGCCGGACTCGGCCCGACGCCCCCGGGCTC
CCGTACCACGTGGCACTGGCCAAACTGGGCCCGCGCGCCATGTCCTGCC
CAGAGGAGAGCAGCCTGATCTCCGCGCTGTCGGACGCCAGCAGCGCGGT
CTATTACAGCGCGTGCATCTCCGGCAGCGGACCG, or a nucleic acid sequence that hybridizes to a nucleic acid sequence consisting of SEQ ID NO:156 under stringent hybridization conditions.

In some embodiments, SRY-box 15 (SOX15) comprises the amino acid sequence:

(SEQ ID NO: 157; NP_008873)
MALPGSSQDQAWSLEPPAATAAASSSSGPQEREGAGSPAAPGTLPLEKV
KRPMNAFMVWSSAQRRQMAQQNPKMHNSEISKRLGAQWKLLDEDEKRPF
VEEAKRLRARHLRDYPDYKYRPRRKAKSSGAGPSRCGQGRGNLASGGPL
WGPGYATTQPSRGFGYRPPSYSTAYLPGSYGSSHCKLEAPSPCSLPQSD
PRLQGELLPTYTHYLPPGSPTPYNPPLAGAPMPLTHL, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:157.

In some embodiments, the nucleic acid sequence encoding SOX15 comprises the nucleic acid sequence:

(SEQ ID NO: 158; NM_006942)

ATGGCGCTACCAGGCTCCTCACAGGACCAGGCCTGGAGCCTGGAGCCTC

CGGCTGCCACGGCTGCTGCCTCCTCATCTTCGGGACCCCAGGAGCGGGA

GGGCGCTGGGAGCCCCGCGGCCCCCGGGACGCTGCCCCTGGAGAAGGTG

AAGCGGCCGATGAACGCGTTCATGGTGTGGAGCTCCGCTCAGCGCCGCC

AGATGGCGCAGCAGAACCCCAAGATGCACAACTCCGAGATCTCCAAGCG

CCTGGGCGCGCAGTGGAAGCTGCTGGACGAGGACGAGAAGCGGCCCTTC

GTGGAGGAGGCCAAGCGGCTCCGCGCCCGACACCTGCGCGACTACCCCG

ACTACAAGTACCGGCCTCGGCGCAAGGCCAAGAGCTCGGGCGCCGGACC

TTCCCGCTGCGGACAGGGAAGAGGCAACCTGGCCAGCGGCGGCCCGCTC

TGGGGGCCGGGGTACGCGACCACCCAACCGAGCAGAGGCTTTGGGTACA

GACCCCCCAGCTACTCGACAGCCTACCTGCCTGGCAGCTATGGCTCTTC

CCACTGCAAACTGGAAGCCCCCTCACCGTGCTCCCTCCCTCAGAGTGAC

CCTAGGCTCCAGGGGGAACTGCTGCCCACCTATACCCACTACCTGCCCC

CTGGCTCTCCCACTCCATACAACCCTCCCCTTGCTGGTGCCCCCATGCC

CCTAACCCACCTC, or a nucleic acid sequence that hybridizes to a nucleic acid sequence consisting of SEQ ID NO:158 under stringent hybridization conditions.

In some embodiments, SRY-box 30 (SOX30) comprises the amino acid sequence:

(SEQ ID NO: 159; NP_848511)

MERARPEPPPQPRPLRPAPPPLPVEGTSFWAAAMEPPPSSPTLSAAASA

TLASSCGEAVASGLQPAVRRLLQVKPEQVLLLPQPQAQNEEAAASSAQA

RLLQFRPDLRLLQPPTASDGATSRPELHPVQPLALHVKAKKQKLGPSLD

QSVGPRGAVETGPRASRVVKLEGPGPALGYFRGDEKGKLEAEEVMRDSM

QGGAGKSPAAIREGVIKTEEPERLLEDCRLGAEPASNGLVHGSAEVILA

PTSGAFGPHQQDLRIPLTLHTVPPGARIQFQGAPPSELIRLTKVPLTPV

PTKMQSLLEPSVKIETKDVPLTVLPSDAGIPDTPFSKDRNGHVKRPMNA

FMVWARIHRPALAKANPAANNAEISVQLGLEWNKLSEEQKKPYYDEAQK

IKEKHREEFPGWVYQPRPGKRKRFPLSVSNVFSGTTKNIISTNPTTVYP

YRSPTYSVVIPSLQNPITHPVGETSPAIQLPTPAVQSPSPVTLFQPSVS

SAAQVAVQDPSLPVYPALPPQRFTGPSQTDTHQLHSEATHTVKQPTPVS

LESANRISSSASTAHARFATSTIQPPREYSSVSPCPRSAPIPQASPIPH

PHVYQPPPLGHPATLFGTPPRFSFHHPYFLPGPHYFPSSTCPYSRPPFG

YGNFPSSMPECLSYYEDRYPKHEGIFSTLNRDYSFRDYSSECTHSENSR

SCENMNGTSYYNSHSHSGEENLNPVPQLDIGTLENVFTAPTSTPSSIQQ

VNVTDSDEEEEEKVLRDL, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:159.

In some embodiments, the nucleic acid sequence encoding SOX30 comprises the nucleic acid sequence:

(SEQ ID NO: 160; NM_178424)

ATGGAGAGAGCCAGACCCGAGCCGCCGCCTCAGCCGCGCCCGTTGCGTC

CCGCTCCGCCCCCGCTGCCGGTCGAGGGCACCTCCTTTTGGGCAGCAGC

CATGGAGCCCCCTCCGTCGTCTCCCACACTGAGCGCGGCAGCCAGTGCG

ACCTTGGCCTCGTCGTGCGGGGAGGCAGTGGCGTCCGGCTTACAGCCCG

CGGTGCGGCGGCTGCTGCAGGTGAAGCCAGAGCAGGTGTTGCTGCTACC

ACAGCCTCAGGCCCAGAACGAGGAAGCCGCTGCCTCGTCCGCGCAGGCG

CGGCTGTTGCAGTTCAGGCCCGACCTGCGGCTCCTGCAGCCGCCGACAG

CGTCAGACGGCGCCACCTCCAGGCCCGAGTTGCACCCGGTGCAGCCCCT

GGCGCTGCATGTCAAGGCCAAGAAGCAGAAGCTGGGGCCCAGCCTGGAT

CAGTCAGTGGGGCCTCGAGGGGCCGTCGAAACCGGTCCTAGAGCCTCCA

GGGTGGTCAAGTTGGAAGGCCCCGGGCCGGCCCTCGGCTACTTCCGAGG

GGACGAGAAGGGCAAGCTGGAGGCGGAGGAGGTCATGAGAGACTCGATG

CAAGGCGGGGCAGGCAAAAGCCCGGCAGCCATCCGAGAAGGTGTGATCA

AAACGGAGGAACCCGAGAGACTCCTCGAGGACTGCAGGCTCGGCGCGGA

GCCCGCGTCCAATGGCCTGGTTCATGGCAGCGCGGAGGTCATCTTGGCC

CCAACGTCCGGTGCCTTTGGGCCGCACCAGCAAGACCTTAGGATCCCTT

TGACGCTCCACACGGTCCCCCCTGGGGCCCGGATCCAGTTTCAGGGAGC

TCCGCCTTCAGAGCTGATAAGATTGACCAAGGTCCCCCTGACACCAGTG

CCTACTAAAATGCAGTCCCTACTGGAGCCTTCTGTAAAAATTGAAACCA

AAGATGTCCCGCTCACCGTGTTGCCCTCAGATGCAGGCATACCAGATAC

TCCCTTCAGTAAGGACAGAAATGGTCATGTGAAGCGACCCATGAACGCA

TTTATGGTTTGGGCAAGGATCCACCGACCAGCACTAGCCAAAGCTAACC

CAGCAGCCAACAATGCAGAAATCAGTGTCCAGCTTGGGTTAGAGTGGAA

CAAACTTAGTGAAGAACAAAAGAAACCCTATTACGATGAAGCACAAAAG

ATTAAGGAAAAGCACAGAGAGGAATTTCCTGGTTGGGTTTATCAGCCTC

GTCCAGGGAAGCGAAAACGATTCCCTCTAAGTGTTTCCAATGTATTTTC

TGGTACCACAAAGAATATCATCTCTACAAATCCTACAACAGTTTATCCT

TACCGCTCACCTACGTACTCTGTGGTAATTCCCAGCCTACAGAATCCCA

TCACTCATCCAGTTGGTGAAACCTCACCTGCTATCCAGCTGCCCACACC

TGCAGTCCAGAGCCCAAGCCCTGTCACACTTTTCCAGCCCAGCGTCTCC

AGTGCTGCTCAGGTGGCTGTCCAGGATCCAAGTCTACCTGTCTATCCAG

CACTCCCACCCCAACGCTTTACTGGGCCTTCCCAAACAGACACTCATCA

GCTGCATTCTGAAGCCACTCACACTGTGAAGCAACCCACTCCTGTCTCT

CTAGAGAGCGCCAACAGGATTTCAAGTAGTGCAAGTACTGCCCATGCCA

GATTTGCAACTTCGACCATCCAACCTCCTAGGGAGTATTCCAGCGTTTC

CCCTTGTCCCAGAAGTGCTCCAATCCCCCAGGCTTCTCCCATTCCACAC

CCACATGTCTACCAGCCCCCTCCCCTTGGCCATCCAGCCACACTGTTCG

GGACACCACCAAGATTCTCTTTTCATCACCCTTACTTCCTACCCGGACC

-continued

TCACTACTTCCCATCAAGTACATGCCCTTACAGTCGGCCTCCCTTTGGC

TATGGAAATTTTCCGAGTTCAATGCCAGAATGCCTTAGTTATTATGAAG

ACAGGTACCCAAAACATGAGGGTATCTTTTCAACTTTAAATAGAGACTA

TTCTTTTAGAGACTACTCAAGTGAATGCACACACAGTGAAAATTCTCGG

AGTTGTGAGAACATGAATGGAACTTCTTACTATAACAGTCATAGCCACA

GTGGGGAAGAAAACTTAAACCCTGTGCCTCAGCTGGACATTGGAACCTT

GGAGAATGTCTTCACAGCCCCGACATCAACTCCTTCTAGCATCCAGCAA

GTCAATGTCACCGACAGTGATGAGGAGGAAGAAGAAAAAGTGCTCAGGG

ATTTA, or a nucleic acid sequence that hybridizes to a nucleic acid sequence consisting of SEQ ID NO:160 under stringent hybridization conditions.

In some embodiments, Notochord Homeobox (NOTO) comprises the amino acid sequence:

(SEQ ID NO: 161; NP_001127934)

MPSPRPRGSPPPAPSGSRVRPPRSGRSPAPRSPTGPNTPRAPGRFESPF

SVEAILARPDPCAPAASQPSGSACVHPAFWTAASLCATGGLPWACPTSW

LPAYLSVGFYPVPGPRVAPVCGLLGFGVTGLELAHCSGLWAFPDWAPTE

DLQDTERQQKRVRTMFNLEQLEELEKVFAKQHNLVGKKRAQLAARLKLT

ENQVRVWFQNRRVKYQKQQKLRAAVTSAEAASLDEPSSSSIASIQSDDA

ESGVDG, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:161.

In some embodiments, the nucleic acid sequence encoding NOTO comprises the nucleic acid sequence:

(SEQ ID NO: 162; NM_001134462)

ATGCCTAGCCCCAGGCCGCGAGGCAGCCCGCCACCCGCTCCCTCGGGCTC

TCGGGTCCGACCTCCGCGCTCTGGCCGCTCTCCGGCGCCCAGGTCCCCTA

CTGGCCCGAACACGCCCCGCGCTCCCGGACGCTTCGAGTCCCCTTTCTCG

GTCGAGGCCATCCTGGCGAGGCCCGACCCCTGCGCGCCGGCGGCCTCCCA

GCCGTCGGGCTCCGCCTGCGTCCACCCGGCCTTCTGGACCGCTGCTTCCC

TGTGCGCCACCGGGGGTCTGCCCTGGGCTTGCCCGACATCGTGGCTGCCC

GCCTACCTGAGCGTAGGTTTTTACCCTGTGCCAGGGCCGCGCGTGGCTCC

CGTCTGCGGCCTGCTGGGCTTCGGCGTCACAGGGTTGGAGCTGGCTCACT

GCTCAGGACTCTGGGCCTTCCCAGACTGGGCCCCAACGGAGGACCTACAG

GACACTGAGAGACAGCAAAAGAGAGTCCGAACTATGTTTAACTTGGAGCA

GCTGGAAGAGTTGGAGAAAGTGTTTGCAAAACAGCACAATCTGGTGGGGA

AGAAGAGAGCCCAGCTGGCAGCTCGGCTCAAACTTACAGAGAACCAGGTG

AGAGTCTGGTTCCAGAACCGCAGGGTCAAGTATCAGAAGCAGCAAAAGCT

-continued

GAGGGCAGCAGTTACATCTGCCGAGGCTGCCTCCCTGGATGAGCCTTCCA

GCAGCTCCATCGCCAGTATCCAGAGTGATGATGCCGAGTCAGGAGTGGAC

GGC, or a nucleic acid sequence that hybridizes to a nucleic acid sequence consisting of SEQ ID NO:162 under stringent hybridization conditions.

In some embodiments, Tenomodulin (TNMD) comprises the amino acid sequence:

(SEQ ID NO: 163; NP_071427)

MAKNPPENCEDCHILNAEAFKSKKICKSLKICGLVFGILTLTLIVLFWGS

KHFWPEVPKKAYDMEHTFYSSGEKKKIYMEIDPVTRTEIFRSGNGTDETL

EVHDFKNGYTGIYFVGLQKCFIKTQIKVIPEFSEPEEEIDENEEITTTFE

QSVIWVPAEKPIENRDFLKNSKILEICDNVTMYWINPTLISVSELQDFEE

EGEDLHFPANEKKGIEQNEQWVVPQVKVEKTRHARQASEEELPINDYTEN

GIEFDPMLDERGYCCIYCRRGNRYCRRVCEPLLGYYPYPYCYQGGRVICR

VIMPCNWWVARMLGRV, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:163.

In some embodiments, the nucleic acid sequence encoding TNMD comprises the nucleic acid sequence:

(SEQ ID NO: 164; NM_022144)

ATGGCAAAGAATCCTCCAGAGAATTGTGAAGACTGTCACATTCTAAATGC

AGAAGCTTTTAAATCCAAGAAAATATGTAAATCACTTAAGATTTGTGGAC

TGGTGTTTGGTATCCTGACCCTAACTCTAATTGTCCTGTTTTGGGGGAGC

AAGCACTTCTGGCCGGAGGTACCCAAAAAAGCCTATGACATGGAGCACAC

TTTCTACAGCAGTGGAGAGAAGAAGAAGATTTACATGGAAATTGATCCTG

TGACCAGAACTGAAATATTCAGAAGCGGAAATGGCACTGATGAAACATTG

GAAGTACACGACTTTAAAAACGGATACACTGGCATCTACTTCGTGGGTCT

TCAAAAATGTTTTATCAAAACTCAGATTAAAGTGATTCCTGAATTTTCTG

AACCAGAAGAGGAAATAGATGAGAATGAAGAAATTACCACAACTTTCTTT

GAACAGTCAGTGATTTGGGTCCCAGCAGAAAAGCCTATTGAAAACCGAGA

TTTTCTTAAAAATTCCAAAATTCTGGAGATTTGTGATAACGTGACCATGT

ATTGGATCAATCCCACTCTAATATCAGTTTCTGAGTTACAAGACTTTGAG

GAGGAGGGAGAAGATCTTCACTTTCCTGCCAACGAAAAAAAAGGGATTGA

ACAAAATGAACAGTGGGTGGTCCCTCAAGTGAAAGTAGAGAAGACCCGTC

ACGCCAGACAAGCAAGTGAGGAAGAACTTCCAATAAATGACTATACTGAA

AATGGAATAGAATTTGATCCCATGCTGGATGAGAGAGGTTATTGTTGTAT

TTACTGCCGTCGAGGCAACCGCTATTGCCGCCGCGTCTGTGAACCTTTAC

-continued

TAGGCTACTACCCATATCCATACTGCTACCAAGGAGGACGAGTCATCTGT

CGTGTCATCATGCCTTGTAACTGGTGGGTGGCCCGCATGCTGGGGAGGGT

C, or a nucleic acid sequence that hybridizes to a nucleic acid sequence consisting of SEQ ID NO:164 under stringent hybridization conditions.

In some embodiments, Human nuclear factor of activated T-cells, cytoplasmic, calcineurin-dependent 1 (NFATc1) comprises the amino acid sequence:

(SEQ ID NO: 165; NP_765978)

MPSTSFPVPSKFPLGPAAAVFGRGETLGPAPRAGGTMKSAEEEHYGYASS

NVSPALPLPTAHSTLPAPCHNLQTSTPGIIPPADHPSGYGAALDGGPAGY

FLSSGHTRPDGAPALESPRIEITSCLGLYHNNNQFFHDVEVEDVLPSSKR

SPSTATLSLPSLEAYRDPSCLSPASSLSSRSCNSEASSYESNYSYPYASP

QTSPWQSPCVSPKTTDPEEGFPRGLGACTLLGSPRHSPSTSPRASVTEES

WLGARSSRPASPCNKRKYSLNGRQPPYSPHHSPTPSPHGSPRVSVTDDSW

LGNTTQYTSSAIVAAINALTTDSSLDLGDGVPVKSRKTTLEQPPSVALKV

EPVGEDLGSPPPPADFAPEDYSSFQHIRKGGFCDQYLAVPQHPYQWAKPK

PLSPTSYMSPTLPALDWQLPSHSGPYELRIEVQPKSHHRAHYETEGSRGA

VKASAGGHPIVQLHGYLENEPLMLQLFIGTADDRLLRPHAFYQVHRITGK

TVSTTSHEAILSNTKVLEIPLLPENSMRAVIDCAGILKLRNSDIELRKGE

TDIGRKNTRVRLVFRVHVPQPSGRTLSLQVASNPIECSQRSAQELPLVEK

QSTDSYPVVGGKKMVLSGHNFLQDSKVIFVEKAPDGHHVWEMEAKTDRDL

CKPNSLVVEIPPFRNQRITSPVHVSFYVCNGKRKRSQYQRFTYLPANGNA

IFLTVSREHERVGCFF, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:165.

In some embodiments, the nucleic acid sequence encoding NFATc1 comprises the nucleic acid sequence:

(SEQ ID NO: 166; NM_172390)

ATGCCAAGCACCAGCTTTCCAGTCCCTTCCAAGTTTCCACTTGGCCCTGC

GGCTGCGGTCTTCGGGAGAGGAGAAACTTTGGGGCCCGCGCCGCGCGCCG

GCGGCACCATGAAGTCAGCGGAGGAAGAACACTATGGCTATGCATCCTCC

AACGTCAGCCCCGCCCTGCCGCTCCCCACGGCGCACTCCACCCTGCCGGC

CCCGTGCCACAACCTTCAGACCTCCACACCGGGCATCATCCCGCCGGCGG

ATCACCCCTCGGGGTACGGGGCAGCTTTGGACGGTGGGCCCGCGGGCTAC

TTCCTCTCCTCCGGCCACACCAGGCCTGATGGGGCCCCTGCCCTGGAGAG

TCCTCGCATCGAGATAACCTCGTGCTTGGGCCTGTACCACAACAATAACC

AGTTTTTCCACGATGTGGAGGTGGAAGACGTCCTCCCTAGCTCCAAACGG

TCCCCCTCCACGGCCACGCTGAGTCTGCCCAGCCTGGAGGCCTACAGAGA

CCCCTCGTGCCTGAGCCCGGCCAGCAGCCTGTCCTCCCGGAGCTGCAACT

-continued

CAGAGGCCTCCTCCTACGAGTCCAACTACTCGTACCCGTACGCGTCCCCC

CAGACGTCGCCATGGCAGTCTCCCTGCGTGTCTCCCAAGACCACGGACCC

CGAGGAGGGCTTTCCCCGCGGGCTGGGGGCCTGCACACTGCTGGGTTCCC

CGCGGCACTCCCCCTCCACCTCGCCCCGCGCCAGCGTCACTGAGGAGAGC

TGGCTGGGTGCCCGCTCCTCCAGACCCGCGTCCCCGTGCAACAAGAGGAA

GTACAGCCTCAACGGCCGGCAGCCGCCCTACTCACCCCACCACTCGCCCA

CGCCGTCCCCGCACGGCTCCCCGCGGGTCAGCGTGACCGACGACTCGTGG

TTGGGCAACACCACCCAGTACACCAGCTCGGCCATCGTGGCCGCCATCAA

CGCGCTGACCACCGACAGCAGCCTGGACCTGGGAGATGGCGTCCCTGTCA

AGTCCCGCAAGACCACCCTGGAGCAGCCGCCCTCAGTGGCGCTCAAGGTG

GAGCCCGTCGGGGAGGACCTGGGCAGCCCCCCGCCCCCGGCCGACTTCGC

GCCCGAAGACTACTCCTCTTTCCAGCACATCAGGAAGGGCGGCTTCTGCG

ACCAGTACCTGGCGGTGCCGCAGCACCCCTACCAGTGGGCGAAGCCCAAG

CCCCTGTCCCCTACGTCCTACATGAGCCCGACCCTGCCCGCCCTGGACTG

GCAGCTGCCGTCCCACTCAGGCCCGTATGAGCTTCGGATTGAGGTGCAGC

CCAAGTCCCACCACCGAGCCCACTACGAGACGGAGGGCAGCCGGGGGGCC

GTGAAGGCGTCGGCCGGAGGACACCCCATCGTGCAGCTGCATGGCTACTT

GGAGAATGAGCCGCTGATGCTGCAGCTTTTCATTGGGACGGCGGACGACC

GCCTGCTGCGCCCGCACGCCTTCTACCAGGTGCACCGCATCACAGGGAAG

ACCGTGTCCACCACCAGCCACGAGGCCATCCTCTCCAACACCAAAGTCCT

GGAGATCCCACTCCTGCCGGAGAACAGCATGCGAGCCGTCATTGACTGTG

CCGGAATCCTGAAACTCAGAAACTCCGACATTGAACTTCGGAAAGGAGAG

ACGGACATCGGGAGGAAGAACACACGGGTACGGCTGGTGTTCCGCGTTCA

CGTCCCGCAACCCAGCGGCCGCACGCTGTCCCTGCAGGTGGCCTCCAACC

CCATCGAATGCTCCCAGCGCTCAGCTCAGGAGCTGCCTCTGGTGGAGAAG

CAGAGCACGGACAGCTATCCGGTCGTGGGCGGGAAGAAGATGGTCCTGTC

TGGCCACAACTTCCTGCAGGACTCCAAGGTCATTTTCGTGGAGAAAGCCC

CAGATGGCCACCATGTCTGGGAGATGGAAGCGAAAACTGACCGGGACCTG

TGCAAGCCGAATTCTCTGGTGGTTGAGATCCCGCCATTTCGGAATCAGAG

GATAACCAGCCCCGTTCACGTCAGTTTCTACGTCTGCAACGGGAAGAGAA

AGCGAAGCCAGTACCAGCGTTTCACCTACCTTCCCGCCAACGGTAACGCC

ATCTTTCTAACCGTAAGCCGTGAACATGAGCGCGTGGGGTGCTTTTTC, or a nucleic acid sequence that hybridizes to a nucleic acid sequence consisting of SEQ ID NO:166 under stringent hybridization conditions.

In some embodiments, Human nuclear factor of activated T-cells, cytoplasmic, calcineurin-dependent 2 (NFATc2) comprises the amino acid sequence:

(SEQ ID NO: 167; NP_036472)

MNAPERQPQPDGGDAPGHEPGGSPQDELDFSILFDYEYLNPNEEEPNAHK

VASPPSGPAYPDDVLDYGLKPYSPLASLSGEPPGRFGEPDRVGPQKFLSA

AKPAGASGLSPRIEITPSHELIQAVGPLRMRDAGLLVEQPPLAGVAASPR

-continued

```
FTLPVPGFEGYREPLCLSPASSGSSASFISDTFSPYTSPCVSPNNGGPDD
LCPQFQNIPAHYSPRTSPIMSPRTSLAEDSCLGRHSPVPRPASRSSSPGA
KRRHSCAEALVALPPGASPQRSRSPSPQPSSHVAPQDHGSPAGYPPVAGS
AVIMDALNSLATDSPCGIPPKMWKTSPDPSPVSAAPSKAGLPRHIYPAVE
FLGPCEQGERRNSAPESILLVPPTWPKPLVPAIPICSIPVTASLPPLEWP
LSSQSGSYELRIEVQPKPHHRAHYETEGSRGAVKAPTGGHPVVQLHGYME
NKPLGLQIFIGTADERILKPHAFYQVHRITGKTVTTTSYEKIVGNTKVLE
IPLEPKNNMRATIDCAGILKLRNADIELRKGETDIGRKNTRVRLVFRVHI
PESSGRIVSLQTASNPIECSQRSAHELPMVERQDTDSCLVYGGQQMILTG
QNFTSESKVVFTEKTTDGQQIWEMEATVDKDKSQPNMLFVEIPEYRNKHI
RTPVKVNFYVINGKRKRSQPQHFTYHPVPAIKTEPTDEYDPTLICSPTHG
GLGSQPYYPQHPMVAESPSCLVATMAPCQQFRTGLSSPDARYQQQNPAAV
LYQRSKSLSPSLLGYQQPALMAAPLSLADAHRSVLVHAGSQGQSSALLHP
SPTNQQASPVIHYSPTNQQLRCGSHQEFQHIMYCENFAPGTTRPGPPPVS
QGQRLSPGSYPTVIQQQNATSQRAAKNGPPVSDQKEVLPAGVTIKQEQNL
DQTYLDDELIDTHLSWIQNIL,
```

or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:167.

In some embodiments, the nucleic acid sequence encoding NFATc2 comprises the nucleic acid sequence:

```
                                    (SEQ ID NO: 168; NM_012340)
ATGAACGCCCCCGAGCGGCAGCCCCAACCCGACGGCGGGGACGCCCCAGG
CCACGAGCCTGGGGGCAGCCCCCAAGACGAGCTTGACTTCTCCATCCTCT
TCGACTATGAGTATTTGAATCCGAACGAAGAAGAGCCGAATGCACATAAG
GTCGCCAGCCCACCCTCCGGACCCGCATACCCCGATGATGTCCTGGACTA
TGGCCTCAAGCCATACAGCCCCCTTGCTAGTCTCTCTGGCGAGCCCCCCG
GCCGATTCGGAGAGCCGGATAGGGTAGGGCCGCAGAAGTTTCTGAGCGCG
GCCAAGCCAGCAGGGGCCTCGGGCCTGAGCCCTCGGATCGAGATCACTCC
GTCCCACGAACTGATCCAGGCAGTGGGGCCCCTCCGCATGAGAGACGCGG
GCCTCCTGGTGGAGCAGCCGCCCCTGGCCGGGGTGGCCGCCAGCCCGAGG
TTCACCCTGCCCGTGCCCGGCTTCGAGGGCTACCGCGAGCCGCTTTGCTT
GAGCCCCGCTAGCAGCGGCTCCTCTGCCAGCTTCATTTCTGACACCTTCT
CCCCCTACACCTCGCCCTGCGTCTCGCCCAATAACGGCGGGCCCGACGAC
CTGTGTCCGCAGTTTCAAAACATCCCTGCTCATTATTCCCCCAGAACCTC
GCCAATAATGTCACCTCGAACCAGCCTCGCCGAGGACAGCTGCCTGGGCC
GCCACTCGCCCGTGCCCCGTCCGGCCTCCCGCTCCTCATCGCCTGGTGCC
AAGCGGAGGCATTCGTGCGCCGAGGCCTTGGTTGCCCTGCCGCCCGGAGC
CTCACCCCAGCGCTCCCGGAGCCCCTCGCCGCAGCCCTCATCTCACGTGG
CACCCCAGGACCACGGCTCCCCGGCTGGGTACCCCCCTGTGGCTGGCTCT
```

-continued

```
GCCGTGATCATGGATGCCCTGAACAGCCTCGCCACGGACTCGCCTTGTGG
GATCCCCCCCAAGATGTGGAAGACCAGCCCTGACCCCTCGCCGGTGTCTG
CCGCCCCATCCAAGGCCGGCCTGCCTCGCCACATCTACCCGGCCGTGGAG
TTCCTGGGGCCCTGCGAGCAGGGCGAGAGGAGAAACTCGGCTCCAGAATC
CATCCTGCTGGTTCCGCCCACTTGGCCCAAGCCGCTGGTGCCTGCCATTC
CCATCTGCAGCATCCCAGTGACTGCATCCCTCCCTCCACTTGAGTGGCCG
CTGTCCAGTCAGTCAGGCTCTTACGAGCTGCGGATCGAGGTGCAGCCCAA
GCCACATCACCGGGCCCACTATGAGACAGAAGGCAGCCGAGGGGCTGTCA
AAGCTCCAACTGGAGGCCACCCTGTGGTTCAGCTCCATGGCTACATGGAA
AACAAGCCTCTGGGACTTCAGATCTTCATTGGGACAGCTGATGAGCGGAT
CCTTAAGCCGCACGCCTTCTACCAGGTGCACCGAATCACGGGGAAAACTG
TCACCACCACCAGCTATGAGAAGATAGTGGGCAACACCAAAGTCCTGGAG
ATACCCTTGGAGCCCAAAAACAACATGAGGGCAACCATCGACTGTGCGGG
GATCTTGAAGCTTAGAAACGCCGACATTGAGCTGCGGAAAGGCGAGACGG
ACATTGGAAGAAAGAACACGCGGGTGAGACTGGTTTTCCGAGTTCACATC
CCAGAGTCCAGTGGCAGAATCGTCTCTTTACAGACTGCATCTAACCCCAT
CGAGTGCTCCCAGCGATCTGCTCACGAGCTGCCCATGGTTGAAAGACAAG
ACACAGACAGCTGCCTGGTCTATGGCGGCCAGCAAATGATCCTCACGGGG
CAGAACTTTACATCCGAGTCCAAAGTTGTGTTTACTGAGAAGACCACAGA
TGGACAGCAAATTTGGGAGATGGAAGCCACGGTGGATAAGGACAAGAGCC
AGCCCAACATGCTTTTTGTTGAGATCCCTGAATATCGGAACAAGCATATC
CGCACACCTGTAAAAGTGAACTTCTACGTCATCAATGGGAAGAGAAAACG
AAGTCAGCCTCAGCACTTTACCTACCACCCAGTCCCAGCCATCAAGACGG
AGCCCACGGATGAATATGACCCCACTCTGATCTGCAGCCCCACCCATGGA
GGCCTGGGGAGCCAGCCTTACTACCCCCAGCACCCGATGGTGGCCGAGTC
CCCCTCCTGCCTCGTGGCCACCATGGCTCCCTGCCAGCAGTTCCGCACGG
GGCTCTCATCCCCTGACGCCCGCTACCAGCAACAGAACCCAGCGGCCGTA
CTCTACCAGCGGAGCAAGAGCCTGAGCCCCAGCCTGCTGGGCTATCAGCA
GCCGGCCCTCATGGCCGCCCCGCTGTCCCTTGCGGACGCTCACCGCTCTG
TGCTGGTGCACGCCGGCTCCCAGGGCCAGAGCTCAGCCCTGCTCCACCCC
TCTCCGACCAACCAGCAGGCCTCGCCTGTGATCCACTACTCACCCACCAA
CCAGCAGCTGCGCTGCGGAAGCCACCAGGAGTTCCAGCACATCATGTACT
GCGAGAATTTCGCACCAGGCACCACCAGACCTGGCCCGCCCCCGGTCAGT
CAAGGTCAGAGGCTGAGCCCGGGTTCCTACCCCACAGTCATTCAGCAGCA
GAATGCCACGAGCCAAAGAGCCGCCAAAAACGGACCCCCGGTCAGTGACC
AAAAGGAAGTATTACCTGCGGGGGTGACCATTAAACAGGAGCAGAACTTG
GACCAGACCTACTTGGATGATGAGCTGATAGACACACACCTTAGCTGGAT
ACAAAACATATTA,
```

or a nucleic acid sequence that hybridizes to a nucleic acid sequence consisting of SEQ ID NO:168 under stringent hybridization conditions.

In some embodiments, Human nuclear factor of activated T-cells, cytoplasmic, calcineurin-dependent 3 (NFATc3) comprises the amino acid sequence:

(SEQ ID NO: 169; NP_004546)

```
MTTANCGAHDELDFKLVFGEDGAPAPPPPGSRPADLEPDDCASIYIFNVD
PPPSTLTTPLCLPHHGLPSHSSVLSPSFQLQSHKNYEGTCEIPESKYSPL
GGPKPFECPSIQITSISPNCHQELDAHEDDLQINDPEREFLERPSRDHLY
LPLEPSYRESSLSPSPASSISSRSWFSDASSCESLSHIYDDVDSELNEAA
ARFTLGSPLTSPGGSPGGCPGEETWHQQYGLGHSLSPRQSPCHSPRSSVT
DENWLSPRPASGPSSRPTSPCGKRRHSSAEVCYAGSLSPHHSPVPSPGHS
PRGSVTEDTWLNASVHGGSGLGPAVFPFQYCVETDIPLKTRKTSEDQAAI
LPGKLELCSDDQGSLSPARETSIDDGLGSQYPLKKDSCGDQFLSVPSPFT
WSKPKPGHTPIFRTSSLPPLDWPLPAHFGQCELKIEVQPKTHHRAHYETE
GSRGAVKASTGGHPVVKLLGYNEKPINLQMFIGTADDRYLRPHAFYQVHR
ITGKTVATASQEIIIASTKVLEIPLLPENNMSASIDCAGILKLRNSDIEL
RKGETDIGRKNTRVRLVFRVHIPQPSGKVLSLQIASIPVECSQRSAQELP
HIEKYSINSCSVNGGHEMVVTGSNFLPESKIIFLEKGQDGRPQWEVEGKI
IREKCQGAHIVLEVPPYHNPAVTAAVQVHFYLCNGKRKKSQSQRFTYTPV
LMKQEHREEIDLSSVPSLPVPHPAQTQRPSSDSGCSHDSVLSGQRSLICS
IPQTYASMVTSSHLPQLQCRDESVSKEQHMIPSPIVHQPFQVTPTPPVGS
SYQPMQTNVVYNGPTCLPINAASSQEFDSVLFQQDATLSGLVNLGCQPLS
SIPFHSSNSGSTGHLLAHTPHSVHTLPHLQSMGYHCSNTGQRSLSSPVAD
QITGQPSSQLQPITYGPSHSGSATTASPAASHPLASSPLSGPPSPQLQPM
PYQSPSSGTASSPSPATRMHSGQHSTQAQSTGQGGLSAPSSLICHSLCDP
ASFPPDGATVSIKPEPEDREPNFATIGLQDITLDDDQFISDLEHQPSGSA
EKWPNHSVLSCPAPFWRI,
```

or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:169.

In some embodiments, the nucleic acid sequence encoding NFATc3 comprises the nucleic acid sequence:

(SEQ ID NO: 170; NM_004555)

```
ATGACTACTGCAAACTGTGGCGCCCACGACGAGCTCGACTTCAAACTCGT
CTTTGGCGAGGACGGGGCGCCGGCGCCGCCGCCCCCGGGCTCGCGGCCTG
CAGATCTTGAGCCAGATGATTGTGCATCCATTTACATCTTTAATGTAGAT
CCACCTCCATCTACTTTAACCACACCACTTTGCTTACCACATCATGGATT
ACCGTCTCACTCTTCTGTTTTGTCACCATCGTTTCAGCTCCAAAGTCACA
AAAACTATGAAGGAACTTGTGAGATTCCTGAATCTAAATATAGCCCATTA
GGTGGTCCCAAACCCTTTGAGTGCCCAAGTATTCAAATTACATCTATCTC
TCCTAACTGTCATCAAGAATTAGATGCACATGAAGATGACCTACAGATAA
ATGACCCAGAACGGGAATTTTTGGAAAGGCCTTCTAGAGATCATCTCTAT
CTTCCTCTTGAGCCATCCTACCGGGAGTCTTCTCTTAGTCCTAGTCCTGC
```

-continued

```
CAGCAGCATCTCTTCTAGGAGTTGGTTCTCTGATGCATCTTCTTGTGAAT
CGCTTTCACATATTTATGATGATGTGGACTCAGAGTTGAATGAAGCTGCA
GCCCGATTTACCCTTGGATCCCCTCTGACTTCTCCTGGTGGCTCTCCAGG
GGGCTGCCCTGGAGAAGAAACTTGGCATCAACAGTATGGACTTGGACACT
CATTATCACCCAGGCAATCTCCTTGCCACTCTCCTAGATCCAGTGTCACT
GATGAGAATTGGCTGAGCCCCAGGCCAGCCTCAGGACCCTCATCAAGGCC
CACATCCCCCTGTGGGAAACGGAGGCACTCCAGTGCTGAAGTTTGTTATG
CTGGGTCCCTTTCACCCCATCACTCACCTGTTCCTTCACCTGGTCACTCC
CCCAGGGGAAGTGTGACAGAAGATACGTGGCTCAATGCTTCTGTCCATGG
TGGGTCAGGCCTTGGCCCTGCAGTTTTTCCATTTCAGTACTGTGTAGAGA
CTGACATCCCTCTCAAAACAAGGAAAACTTCTGAAGATCAAGCTGCCATA
CTACCAGGAAAATTAGAGCTGTGTTCAGATGACCAAGGGAGTTTATCACC
AGCCCGGGAGACTTCAATAGATGATGGCCTTGGATCTCAGTATCCTTTAA
AGAAAGATTCATGTGGTGATCAGTTTCTTTCAGTTCCTTCACCCTTTACC
TGGAGCAAACCAAAGCCTGGCCACACCCCTATATTTCGCACATCTTCATT
ACCTCCACTAGACTGGCCTTTACCAGCTCATTTTGGACAATGTGAACTGA
AAATAGAAGTGCAACCTAAAACTCATCATCGAGCCCATTATGAAACTGAA
GGTAGCCGAGGGGCAGTAAAAGCATCTACTGGGGGACATCCTGTTGTGAA
GCTCCTGGGCTATAACGAAAAGCCAATAAATCTACAAATGTTTATTGGGA
CAGCAGATGATCGATATTTACGACCTCATGCATTTTACCAGGTGCATCGA
ATCACTGGGAAGACAGTCGCTACTGCAAGCCAAGAGATAATAATTGCCAG
TACAAAAGTTCTGGAAATTCCACTTCTTCCTGAAAATAATATGTCAGCCA
GTATTGATTGTGCAGGTATTTTGAAACTCCGCAATTCAGATATAGAACTT
CGAAAAGGAGAAACTGATATTGGCAGAAAGAATACTAGAGTACGACTTGT
GTTTCGTGTACACATCCCACAGCCCAGTGGAAAAGTCCTTTCTCTGCAGA
TAGCCTCTATACCCGTTGAGTGCTCCCAGCGGTCTGCTCAAGAACTTCCT
CATATTGAGAAGTACAGTATCAACAGTTGTTCTGTAAATGGAGGTCATGA
AATGGTTGTGACTGGATCTAATTTTCTTCCAGAATCCAAAATCATTTTTC
TTGAAAAAGGACAAGATGGACGACCTCAGTGGGAGGTAGAAGGGAAGATA
ATCAGGGAAAAATGTCAAGGGGCTCACATTGTCCTTGAAGTTCCTCCATA
TCATAACCCAGCAGTTACAGCTGCAGTGCAGGTGCACTTTTATCTTTGCA
ATGGCAAGAGGAAAAAAAGCCAGTCTCAACGTTTTACTTATACACCAGTT
TTGATGAAGCAAGAACACAGAGAAGAGATTGATTTGTCTTCAGTTCCATC
TTTGCCTGTGCCTCATCCTGCTCAGACCCAGAGGCCTTCCTCTGATTCAG
GGTGTTCACATGACAGTGTACTGTCAGGACAGAGAAGTTTGATTTGCTCC
ATCCCACAAACATATGCATCCATGGTGACCTCATCCCATCTGCCACAGTT
GCAGTGTAGAGATGAGAGTGTTAGTAAAGAACAGCATATGATTCCTTCTC
CAATTGTACACCAGCCTTTTCAAGTCACACCAACACCTCCTGTGGGGTCT
TCCTATCAGCCTATGCAAACTAATGTTGTGTACAATGGACCAACTTGTCT
TCCTATTAATGCTGCCTCTAGTCAAGAATTTGATTCAGTTTTGTTTCAGC
```

-continued

AGGATGCAACTCTTTCTGGTTTAGTGAATCTTGGCTGTCAACCACTGTCA

TCCATACCATTTCATTCTTCAAATTCAGGCTCAACAGGACATCTCTTAGC

CCATACACCTCATTCTGTGCATACCCTGCCTCATCTGCAATCAATGGGAT

ATCATTGTTCAAATACAGGACAAAGATCTCTTTCTTCTCCAGTGGCTGAC

CAGATTACAGGTCAGCCTTCGTCTCAGTTACAACCTATTACATATGGTCC

TTCACATTCAGGGTCTGCTACAACAGCTTCCCCAGCAGCTTCTCATCCCT

TGGCTAGTTCACCGCTTTCTGGGCCACCATCTCCTCAGCTTCAGCCTATG

CCTTACCAATCTCCTAGCTCAGGAACTGCCTCATCACCGTCTCCAGCCAC

CAGAATGCATTCTGGACAGCACTCAACTCAAGCACAAAGTACGGGCCAGG

GGGGTCTTTCTGCACCTTCATCCTTAATATGTCACAGTTTGTGTGATCCA

GCGTCATTTCCACCTGATGGGGCAACTGTGAGCATTAAACCTGAACCAGA

AGATCGAGAGCCTAACTTTGCAACCATTGGTCTGCAGGACATCACTTTAG

ATGATGACCAATTTATATCTGACTTGGAACACCAGCCATCAGGTTCAGCA

GAGAAATGGCCTAACCACAGTGTGCTCTCATGTCCAGCTCCTTTCTGGAG

AATC, or a nucleic acid sequence that hybridizes to a nucleic acid sequence consisting of SEQ ID NO:170 under stringent hybridization conditions.

In some embodiments, Human nuclear factor of activated T-cells, cytoplasmic, calcineurin-dependent 4 (NFATc4) comprises the amino acid sequence:

(SEQ ID NO: 171; NP_001129494)

MITTLPSLLPASLASISHRVTNLPSNSLSHNPGLSKPDFPGNSSPGLPSS

SSPGRDLGAPAGSMGAASCEDEELEFKLVFGEEKEAPPLGAGGLGEELDS

EDAPPCCRLALGEPPPYGAAPIGIPRPPPPRPGMHSPPPRPAPSPGTWES

QPARSVRLGGPGGGAGGAGGGRVLECPSIRITSISPTPEPPAALEDNPDA

WGDGSPRDYPPPEGFGGYREAGGQGGGAFFSPSPGSSSLSSWSFFSDASD

EAALYAACDEVESELNEAASRFGLGSPLPSPRASPRPVVTPEDPWSLYGP

SPGGRGPEDSWLLLSAPGPTPASPRPASPCGKRRYSSSGTPSSASPALSR

RGSLGEEGSEPPPPPPLPLARDPGSPGPFDYVGAPPAESIPQKTRRTSSE

QAVALPRSEEPASCNGKLPLGAEESVAPPGGSRKEVAGMDYLAVPSPLAW

SKARIGGHSPIFRTSALPPLDWPLPSQYEQLELRIEVQPRAHHRAHYETE

GSRGAVKAAPGGHPVVKLLGYSEKPLTLQMFIGTADERNLRPHAFYQVHR

ITGKMVATASYEAVVSGTKVLEMTLLPENNMAANIDCAGILKLRNSDIEL

RKGETDIGRKNTRVRLVFRVHVPQGGGKVVSVQAASVPIECSQRSAQELP

QVEAYSPSACSVRGGEELVLTGSN FLPDSKVVFIERGPDGKLQWEEEAT

VNRLQSNEVTLTLTVPEYSNKRVSRPVQVYFYVSNGRRKRSPTQSFRFLP

VICKEEPLPDSSLRGFPSASATPFGTDMDFSPPRPPYPSYPHEDPACETP

YLSEGFGYGMPPLYPQTGPPPSYRPGLRMFPETRGTTGCAQPPAVSFLPR

PFPSDPYGGRGSSFSLGLPFSPPAPFRPPPLPASPPLEGPFPSQSDVHPL

PAEGYNKVGPGYGPGEGAPEQEKSRGGYSSGFRDSVPIQGITLEEGGCGT

GGCECECVQEIALHVC, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:171.

In some embodiments, the nucleic acid sequence encoding NFATc4 comprises the nucleic acid sequence:

(SEQ ID NO: 172; NM_001136022)

ATGATAACCACCCTCCCATCTCTCCTACCCGCCAGCCTCGCCAGTATCTC

CCACCGAGTCACGAATCTCCCATCTAACTCCCTCTCACACAACCCAGGCC

TCTCCAAGCCTGACTTTCCCGGAAACTCCAGTCCAGGTCTTCCTTCCTCC

TCCAGCCCAGGCCGGGACCTGGGGGCTCCTGCCGGATCCATGGGGGCGGC

CAGCTGCGAGGATGAGGAGCTGGAATTTAAGCTGGTGTTCGGGGAGGAAA

AGGAGGCCCCCCCGCTGGGCGCGGGGGGATTGGGGGAAGAACTGGACTCA

GAGGATGCCCCGCCATGCTGCCGTCTGGCCTTGGGAGAGCCCCCTCCCTA

TGGCGCTGCACCTATCGGTATTCCCCGACCTCCACCCCCTCGGCCTGGCA

TGCATTCGCCACCGCCGCGACCAGCCCCCTCACCTGGCACCTGGGAGAGC

CAGCCCGCCAGGTCGGTGAGGCTGGGAGGACCAGGAGGGGGTGCTGGGGG

TGCTGGGGGTGGCCGTGTTCTCGAGTGTCCCAGCATCCGCATCACCTCCA

TCTCTCCCACGCCGGAGCCGCCAGCAGCGCTGGAGGACAACCCTGATGCC

TGGGGGGACGGCTCTCCTAGAGATTACCCCCCACCAGAAGGCTTTGGGGG

CTACAGAGAAGCAGGGGGCCAGGGTGGGGGGGCCTTCTTCAGCCCAAGCC

CTGGCAGCAGCAGCCTGTCCTCGTGGAGCTTCTTCTCCGATGCCTCTGAC

GAGGCAGCCCTGTATGCAGCCTGCGACGAGGTGGAGTCTGAGCTAAATGA

GGCGGCCTCCCGCTTTGGCCTGGGCTCCCCGCTGCCCTCGCCCCGGGCCT

CCCCTCGGCCATGGACCCCCGAAGATCCCTGGAGCCTGTATGGTCCAAGC

CCCGGAGGCCGAGGGCCAGAGGATAGCTGGCTACTCCTCAGTGCTCCTGG

GCCCACCCCAGCCTCCCCGCGGCCTGCCTCTCCATGTGGCAAGCGGCGCT

ATTCCAGCTCGGGAACCCCATCTTCAGCCTCCCCAGCTCTGTCCCGCCGT

GGCAGCCTGGGGGAAGAGGGGTCTGAGCCACCTCCACCACCCCCATTGCC

TCTGGCCCGGGACCCGGGCTCCCCTGGTCCCTTTGACTATGTGGGGGCCC

CACCAGCTGAGAGCATCCCTCAGAAGACACGGCGGACTTCCAGCGAGCAG

GCAGTGGCTCTGCCTCGGTCTGAGGAGCCTGCCTCATGCAATGGGAAGCT

GCCCTTGGGAGCAGAGGAGTCTGTGGCTCCTCCAGGAGGTTCCCGGAAGG

AGGTGGCTGGCATGGACTACCTGGCAGTGCCCTCCCCACTCGCTTGGTCC

AAGGCCCGGATTGGGGGACACAGCCCTATCTTCAGGACCTCTGCCCTACC

CCCACTGGACTGGCCTCTGCCCAGCCAATATGAGCAGCTGGAGCTGAGGA

TCGAGGTACAGCCTAGAGCCCACCACCGGGCCCACTATGAGACAGAAGGC

AGCCGTGGAGCTGTCAAAGCTGCCCCTGGCGGTCACCCCGTAGTCAAGCT

CCTAGGCTACAGTGAGAAGCCACTGACCCTACAGATGTTCATCGGCACTG

CAGATGAAAGGAACCTGCGGCCTCATGCCTTCTATCAGGTGCACCGTATC

ACAGGCAAGATGGTGGCCACGGCCAGCTATGAAGCCGTAGTCAGTGGCAC

CAAGGTGTTGGAGATGACTCTGCTGCCTGAGAACAACATGGCGGCCAACA

-continued

```
TTGACTGCGCGGGAATCCTGAAGCTTCGGAATTCAGACATTGAGCTTCGG
AAGGGTGAGACGGACATCGGGCGCAAAAACACACGTGTACGGCTGGTGTT
CCGGGTACACGTGCCCCAGGGCGGCGGGAAGGTCGTCTCAGTACAGGCAG
CATCGGTGCCCATCGAGTGCTCCCAGCGCTCAGCCCAGGAGCTGCCCCAG
GTGGAGGCCTACAGCCCCAGTGCCTGCTCTGTGAGAGGAGGCGAGGAACT
GGTACTGACTGGCTCCAACTTCCTGCCAGACTCCAAGGTGGTGTTCATTG
AGAGGGGTCCTGATGGGAAGCTGCAATGGGAGGAGGAGGCCACAGTGAAC
CGACTGCAGAGCAACGAGGTGACGCTGACCCTGACTGTCCCCGAGTACAG
CAACAAGAGGGTTTCCCGGCCAGTCCAGGTCTACTTTTATGTCTCCAATG
GGCGGAGGAAACGCAGTCCTACCCAGAGTTTCAGGTTTCTGCCTGTGATC
TGCAAAGAGGAGCCCCTACCGGACTCATCTCTGCGGGGTTTCCCTTCAGC
ATCGGCAACCCCCTTTGGCACTGACATGGACTTCTCACCACCCAGGCCCC
CCTACCCCTCCTATCCCCATGAAGACCCTGCTTGCGAAACTCCTTACCTA
TCAGAAGGCTTCGGCTATGGCATGCCCCCTCTGTACCCCCAGACGGGGCC
CCCACCATCCTACAGACCGGGCCTGCGGATGTTCCCTGAGACTAGGGGTA
CCACAGGTTGTGCCCAACCACCTGCAGTTTCCTTCCTTCCCCGCCCCTTC
CCTAGTGACCCGTATGGAGGGCGGGGCTCCTCTTTCTCCCTGGGGCTGCC
ATTCTCTCCGCCAGCCCCCTTTCGGCCGCCTCCTCTTCCTGCATCCCCAC
CGCTTGAAGGCCCCTTCCCTTCCCAGAGTGATGTGCATCCCCTACCTGCT
GAGGGATACAATAAGGTAGGGCCAGGCTATGGCCCTGGGGAGGGGGCTCC
GGAGCAGGAGAAATCCAGGGGTGGCTACAGCAGCGGCTTCCGAGACAGTG
TCCCTATCCAGGGTATCACGCTGGAGGAAGGTGGGTGTGGGACTGGGGGC
TGTGAGTGTGAGTGTGTGCAAGAGATTGCTCTGCATGTTTGC,
```

or a nucleic acid sequence that hybridizes to a nucleic acid sequence consisting of SEQ ID NO:172 under stringent hybridization conditions.

In some embodiments, Human v-ets erythroblastosis virus E26 oncogene homolog (ERG, C-1-1 is a variant) comprises the amino acid sequence:

```
(SEQ ID NO: 173; NP_001129626)
IQTVPDPAAHIKEALSVVSEDQSLFECAYGTPHLAKTEMTASSSSDYGQT
SKMSPRVPQQDWLSQPPARVTIKMECNPSQVNGSRNSPDECSVAKGGKMV
GSPDTVGMNYGSYMEEKHMPPPNMTTNERRVIVPADPTLWSTDHVRQWLE
WAVKEYGLPDVNILLFQNIDGKELCKMTKDDFQRLTPSYNADILLSHLHY
LRETPLPHLTSDDVDKALQNSPRLMHARNTGGAAFIFPNTSVYPEATQRI
TTRPDLPYEPPRRSAWTGHGHPTPQSKAAQPSPSTVPKTEDQRPQLDPYQ
ILGPTSSRLANPGSGQIQLWQFLLELLSDSSNSSCITWEGTNGEFKMTDP
DEVARRWGERKSKPNMNYDKLSRALRYYYDKNIMTKVHGKRYAYKFDFHG
IAQALQPHPPESSLYKYPSDLPYMGSYHAHPQKMNFVAPHPPALPVTSSS
FFAAPNPYWNSPTGGIYPNTRLPTSHMPSHLGTYY,
```

or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:173.

In some embodiments, the nucleic acid sequence encoding ERG comprises the nucleic acid sequence

```
(SEQ ID NO: 174; NM_001136154)
ATGATTCAGACTGTCCCGGACCCAGCAGCTCATATCAAGGAAGCCTTAT
CAGTTGTGAGTGAGGACCAGTCGTTGTTTGAGTGTGCCTACGGAACGCC
ACACCTGGCTAAGACAGAGATGACCGCGTCCTCCTCCAGCGACTATGGA
CAGACTTCCAAGATGAGCCCACGCGTCCCTCAGCAGGATTGGCTGTCTC
AACCCCCAGCCAGGGTCACCATCAAAATGGAATGTAACCCTAGCCAGGT
GAATGGCTCAAGGAACTCTCCTGATGAATGCAGTGTGGCCAAAGGCGGG
AAGATGGTGGGCAGCCCAGACACCGTTGGGATGAACTACGGCAGCTACA
TGGAGGAGAAGCACATGCCACCCCCAAACATGACCACGAACGAGCGCAG
AGTTATCGTGCCAGCAGATCCTACGCTATGGAGTACAGACCATGTGCGG
CAGTGGCTGGAGTGGGCGGTGAAAGAATATGGCCTTCCAGACGTCAACA
TCTTGTTATTCCAGAACATCGATGGGAAGGAACTGTGCAAGATGACCAA
GGACGACTTCCAGAGGCTCACCCCCAGCTACAACGCCGACATCCTTCTC
TCACATCTCCACTACCTCAGAGAGACTCCTCTTCCACATTTGACTTCAG
ATGATGTTGATAAAGCCTTACAAAACTCTCCACGGTTAATGCATGCTAG
AAACACAGGGGGTGCAGCTTTTATTTTCCCAAATACTTCAGTATATCCT
GAAGCTACGCAAAGAATTACAACTAGGCCAGATTTACCATATGAGCCCC
CCAGGAGATCAGCCTGGACCGGTCACGGCCACCCCACGCCCCAGTCGAA
AGCTGCTCAACCATCTCCTTCCACAGTGCCCAAAACTGAAGACCAGCGT
CCTCAGTTAGATCCTTATCAGATTCTTGGACCAACAAGTAGCCGCCTTG
CAAATCCAGGCAGTGGCCAGATCCAGCTTTGGCAGTTCCTCCTGGAGCT
CCTGTCGGACAGCTCCAACTCCAGCTGCATCACCTGGGAAGGCACCAAC
GGGGAGTTCAAGATGACGGATCCCGACGAGGTGGCCCGGCGCTGGGGAG
AGCGGAAGAGCAAACCCAACATGAACTACGATAAGCTCAGCCGCGCCCT
CCGTTACTACTATGACAAGAACATCATGACCAAGGTCCATGGGAAGCGC
TACGCCTACAAGTTCGACTTCCACGGGATCGCCCAGGCCCTCCAGCCCC
ACCCCCCGGAGTCATCTCTGTACAAGTACCCCTCAGACCTCCCGTACAT
GGGCTCCTATCACGCCCACCCACAGAAGATGAACTTTGTGGCGCCCCAC
CCTCCAGCCCTCCCCGTGACATCTTCCAGTTTTTTTGCTGCCCCAAACC
CATACTGGAATTCACCAACTGGGGGTATATACCCCAACACTAGGCTCCC
CACCAGCCATATGCCTTCTCATCTGGGCACTTACTAC,
```

or a nucleic acid sequence that hybridizes to a nucleic acid sequence consisting of SEQ ID NO:174 under stringent hybridization conditions.

In some embodiments, PGC1α comprises the amino acid sequence: MAWDMCNQDSESVWSDIECAALVGEDQPLCPDLPELDLSELDVNDLDTDSFLGGLKW CSDQSEIISNQYNNEPSNIFEKIDEENEANLLAVLTETLDSLPVDEDGLPSFDALTDGDV

```
(SEQ ID NO: 175; NP_037393)
TTDNEASPSSMPDGTPPPQEAEEPSLLKKLLLAPANTQLSYNECSGLST
QNHANHNHRIRTNPAIVKTENSWSNKAKSICQQQKPQRRPCSELLKYLT
```

-continued

TNDDPPHTKPTENRNSSRDKCTSKKKSHTQSQSQHLQAKPTTLSLPLTP
ESPNDPKGSPFENKTIERTLSVELSGTAGLTPPTTPPHKANQDNPFRAS
PKLKSSCKTVVPPPSKKPRYSESSGTQGNNSTKKGPEQSELYAQLSKSS
VLTGGHEERKTKRPSLRLFGDHDYCQSINSKTEILINISQELQDSRQLE
NKDVSSDWQGQICSSTDSDQCYLRETLEASKQVSPCSTRKQLQDQEIRA
ELNKHFGHPSQAVFDDEADKTSELRDSDFSNEQFSKLPMFINSGLAMDG
LFDDSEDESDKLSYPWDGTQSYSLFNVSPSCSSFNSPCRDSVSPPKSLF
SQRPQRMRSRSRSFSRHRSCSRSPYSRSRSRSPGSRSSSRSCYYYESSH
YRHRTHRNSPLYVRSRSRSPYSRRPRYDSYEEYQHERLKREEYRREYEK
RESERAKQRERQRQKAIEERRVIYVGKIRPDTTRTELRDRFEVFGEIEE
CTVNLRDDGDSYGFITYRYTCDAFAALENGYTLRRSNETDFELYFCGRK
QFFKSNYADLDSNSDDFDPASTKSKYDSLDFDSLLKEAQRSLRR, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:175.

In some embodiments, the nucleic acid sequence encoding PGC1a comprises the nucleic acid sequence:

(SEQ ID NO: 176; NM_013261)

ATGGCGTGGGACATGTGCAACCAGGACTCTGAGTCTGTATGGAGTGACA
TCGAGTGTGCTGCTCTGGTTGGTGAAGACCAGCCTCTTTGCCCAGATCT
TCCTGAACTTGATCTTTCTGAACTAGATGTGAACGACTTGGATACAGAC
AGCTTTCTGGGTGGACTCAAGTGGTGCAGTGACCAATCAGAAATAATAT
CCAATCAGTACAACAATGAGCCTTCAAACATATTTGAGAAGATAGATGA
AGAGAATGAGGCAAACTTGCTAGCAGTCCTCACAGAGACACTAGACAGT
CTCCCTGTGGATGAAGACGGATTGCCCTCATTTGATGCGCTGACAGATG
GAGACGTGACCACTGACAATGAGGCTAGTCCTTCCTCCATGCCTGACGG
CACCCCTCCACCCCAGGAGGCAGAAGAGCCGTCTCTACTTAAGAAGCTC
TTACTGGCACCAGCCAACACTCAGCTAAGTTATAATGAATGCAGTGGTC
TCAGTACCCAGAACCATGCAAATCACAATCACAGGATCAGAACAAACCC
TGCAATTGTTAAGACTGAGAATTCATGGAGCAATAAAGCGAAGAGTATT
TGTCAACAGCAAAAGCCACAAAGACGTCCCTGCTCGGAGCTTCTCAAAT
ATCTGACCACAAACGATGACCCTCCTCACACCAAACCCACAGAGAACAG
AAACAGCAGCAGAGACAAATGCACCTCCAAAAAGAAGTCCCACACACAG
TCGCAGTCACAACACTTACAAGCCAAACCAACAACTTTATCTCTTCCTC
TGACCCCAGAGTCACCAAATGACCCCAAGGGTTCCCCATTTGAGAACAA
GACTATTGAACGCACCTTAAGTGTGGAACTCTCTGGAACTGCAGGCCTA
ACTCCACCCACCACTCCTCCTCATAAAGCCAACCAAGATAACCCTTTTA
GGGCTTCTCCAAAGCTGAAGTCCTCTTGCAAGACTGTGGTGCCACCACC
ATCAAAGAAGCCCAGGTACAGTGAGTCTTCTGGTACACAAGGCAATAAC
TCCACCAAGAAAGGGCCGGAGCAATCCGAGTTGTATGCACAACTCAGCA

-continued

AGTCCTCAGTCCTCACTGGTGGACACGAGGAAAGGAAGACCAAGCGGCC
CAGTCTGCGGCTGTTTGGTGACCATGACTATTGCCAGTCAATTAATTCC
AAAACGGAAATACTCATTAATATATCACAGGAGCTCCAAGACTCTAGAC
AACTAGAAAATAAAGATGTCTCCTCTGATTGGCAGGGGCAGATTTGTTC
TTCCACAGATTCAGACCAGTGCTACCTGAGAGAGACTTTGGAGGCAAGC
AAGCAGGTCTCTCCTTGCAGCACAAGAAAACAGCTCCAAGACCAGGAAA
TCCGAGCCGAGCTGAACAAGCACTTCGGTCATCCCAGTCAAGCTGTTTT
TGACGACGAAGCAGACAAGACCAGTGAACTGAGGGACAGTGATTTCAGT
AATGAACAATTCTCCAAACTACCTATGTTTATAAATTCAGGACTAGCCA
TGGATGGCCTGTTTGATGACAGCGAAGATGAAAGTGATAAACTGAGCTA
CCCTTGGGATGGCACACAATCCTATTCATTGTTCAATGTGTCTCCTTCT
TGTTCTTCTTTTAACTCTCCATGTAGAGATTCTGTGTCACCACCCAAAT
CCTTATTTTCTCAAAGACCCCAAAGGATGCGCTCTCGTTCAAGGTCCTT
TTCTCGACACAGGTCGTGTTCCCGATCACCATATTCCAGGTCAAGATCA
AGGTCTCCAGGCAGTAGATCCTCTTCAAGATCCTGCTATTACTATGAGT
CAAGCCACTACAGACACCGCACGCACCGAAATTCTCCCTTGTATGTGAG
ATCACGTTCAAGATCGCCCTACAGCCGTCGGCCCAGGTATGACAGCTAC
GAGGAATATCAGCACGAGAGGCTGAAGAGGGAAGAATATCGCAGAGAGT
ATGAGAAGCGAGAGTCTGAGAGGGCCAAGCAAAGGGAGAGGCAGAGGCA
GAAGGCAATTGAAGAGCGCCGTGTGATTTATGTCGGTAAAATCAGACCT
GACACAACACGGACAGAACTGAGGGACCGTTTTGAAGTTTTTGGTGAAA
TTGAGGAGTGCACAGTAAATCTGCGGGATGATGGAGACAGCTATGGTTT
CATTACCTACCGTTATACCTGTGATGCTTTTGCTGCTCTTGAAAATGGA
TACACTTTGCGCAGGTCAAACGAAACTGACTTTGAGCTGTACTTTTGTG
GACGCAAGCAATTTTTCAAGTCTAACTATGCAGACCTAGATTCAAACTC
AGATGACTTTGACCCTGCTTCCACCAAGAGCAAGTATGACTCTCTGGAT
TTTGATAGTTTACTGAAAGAAGCTCAGAGAAGCTTGCGCAGG, or a nucleic acid sequence that hybridizes to a nucleic acid sequence consisting of SEQ ID NO:176 under stringent hybridization conditions.

In some embodiments, Osterix (SP7) comprises the amino acid sequence:

(SEQ ID NO: 177; NP_690599)

MASSLLEEEVHYGSSPLAMLTAACSKFGGSSPLRDSTTLGKAGTKKPYS
VGSDLSASKTMGDAYPAPFTSTNGLLSPAGSPPAPTSGYANDYPPFSHS
FPGPTGTQDPGLLVPKGHSSSDCLPSVYTSLDMTHPYGSWYKAGIHAGI
SPGPGNTPTPWWDMHPGGNWLGGGQGQGDGLQGTLPTGPAQPPLNPQLP
TYPSDFAPLNPAPYPAPHLLQPGPQHVLPQDVYKPKAVGNSGQLEGSGG
AKPPRGASTGGSGGYGGSGAGRSSCDCPNCQELERLGAAAAGLRKKPIH
SCHIPGCGKVYGKASHLKAHLRWHTGERPFVCNWLFCGKRFTRSDELER
HVRTHTREKKFTCLLCSKRFTRSDHLSKHQRTHGEPGPGPPPSGPKELG
EGRSTGEEEASQTPRPSASPATPEKAPGGSPEQSNLLEI, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:177.

In some embodiments, the nucleic acid sequence encoding Osterix comprises the nucleic acid sequence:

(SEQ ID NO: 178; NM_152860)

```
ATGGCGTCCTCCCTGCTTGAGGAGGAAGTTCACTATGGCTCCAGTCCCC
TGGCCATGCTGACGGCAGCGTGCAGCAAATTTGGTGGCTCTAGCCCTCT
GCGGGACTCAACAACTCTGGGCAAAGCAGGCACAAAGAAGCCGTACTCT
GTGGGCAGTGACCTTTCAGCCTCCAAAACCATGGGGGATGCTTATCCAG
CCCCCTTTACAAGCACTAATGGGCTCCTTTCACCTGCAGGCAGTCCTCC
AGCACCCACCTCAGGCTATGCTAATGATTACCCTCCCTTTTCCCACTCA
TTCCCTGGGCCCACAGGCACCCAGGACCCTGGGCTACTAGTGCCCAAGG
GGCACAGCTCTTCTGACTGTCTGCCCAGTGTCTACACCTCTCTGGACAT
GACACACCCCTATGGCTCCTGGTACAAGGCAGGCATCCATGCAGGCATT
TCACCAGGCCCAGGCAACACTCCTACTCCATGGTGGGATATGCACCCTG
GAGGCAACTGGCTAGGTGGTGGGCAGGGCCAGGGTGATGGGCTGCAAGG
GACACTGCCCACAGGTCCAGCTCAGCCTCCACTGAACCCCCAGCTGCCC
ACCTACCCATCTGACTTTGCTCCCCTTAATCCAGCCCCCTACCCAGCTC
CCCACCTCTTGCAACCAGGGCCCCAGCATGTCTTGCCCCAAGATGTCTA
TAAACCCAAGGCAGTGGGAAATAGTGGGCAGCTAGAAGGGAGTGGTGGA
GCCAAACCCCCACGGGGTGCAAGCACTGGGGGTAGTGGTGGATATGGGG
GCAGTGGGGCAGGGCGCTCCTCCTGCGACTGCCCTAATTGCCAGGAGCT
AGAGCGGCTGGGAGCAGCAGCGGCTGGGCTGCGGAAGAAGCCCATCCAC
AGCTGCCACATCCCTGGCTGCGGCAAGGTGTATGGCAAGGCTTCGCACC
TGAAGGCCCACTTGCGCTGGCACACAGGCGAGAGGCCCTTCGTCTGCAA
CTGGCTCTTCTGCGGCAAGAGGTTCACTCGTTCGGATGAGCTGGAGCGT
CATGTGCGCACTCACACCCGGGAGAAGAAGTTCACCTGCCTGCTCTGCT
CCAAGCGCTTTACCCGAAGTGACCACCTGAGCAAACACCAGCGCACCCA
CGGAGAACCAGGCCCGGGTCCCCCTCCCAGTGGCCCCAAGGAGCTGGGG
GAGGGCCGCAGCACGGGGGAAGAGGAGGCCAGTCAGACGCCCCGACCTT
CTGCCTCGCCAGCAACCCCAGAGAAAGCCCCTGGAGGCAGCCCTGAGCA
GAGCAACTTGCTGGAGATC,
```

or a nucleic acid sequence that hybridizes to a nucleic acid sequence consisting of SEQ ID NO:178 under stringent hybridization conditions.

In some embodiments, myocyte enhancer factor 2C (MEF2C) comprises the amino acid sequence:

(SEQ ID NO: 179; NP_002388)

```
MGRKKIQITRIMDERNRQVTFTKRKFGLMKKAYELSVLCDCEIALIIFN
STNKLFQYASTDMDKVLLKYTEYNEPHESRTNSDIVETLRKKGLNGCDS
PDPDADDSVGHSPESEDKYRKINEDIDLMISRQRLCAVPPPNFEMPVSI
PVSSHNSLVYSNPVSSLGNPNLLPLAHPSLQRNSMSPGVTHRPPSAGNT
```

-continued

```
GGLMGGDLTSGAGTSAGNGYGNPRNSPGLLVSPGNLNKNMQAKSPPPMN
LGMNNRKPDLRVLIPPGSKNTMPSVSEDVDLLLNQRINNSQSAQSLATP
VVSVATPTLPGQGMGGYPSAISTTYGTEYSLSSADLSSLSGFNTASALH
LGSVTGWQQQHLHNMPPSALSQLGACTSTHLSQSSNLSLPSTQSLNIKS
EPVSPPRDRTTTPSRYPQHTRHEAGRSPVDSLSSCSSSYDGSDREDHRN
EFHSPIGLTRPSPDERESPSVKRMRLSEGWAT,
```

or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:179.

In some embodiments, the nucleic acid sequence encoding MEF2C comprises the nucleic acid sequence:

(SEQ ID NO: 180; NM_002397)

```
ATGGGGAGAAAAAAGATTCAGATTACGAGGATTATGGATGAACGTAACA
GACAGGTGACATTTACAAAGAGGAAATTTGGGTTGATGAAGAAGGCTTA
TGAGCTGAGCGTGCTGTGTGACTGTGAGATTGCGCTGATCATCTTCAAC
AGCACCAACAAGCTGTTCCAGTATGCCAGCACCGACATGGACAAAGTGC
TTCTCAAGTACACGGAGTACAACGAGCCGCATGAGAGCCGGACAAACTC
AGACATCGTGGAGACGTTGAGAAAGAAGGGCCTTAATGGCTGTGACAGC
CCAGACCCCGATGCGGACGATTCCGTAGGTCACAGCCCTGAGTCTGAGG
ACAAGTACAGGAAAATTAACGAAGATATTGATCTAATGATCAGCAGGCA
AAGATTGTGTGCTGTTCCACCTCCCAACTTCGAGATGCCAGTCTCCATC
CCAGTGTCCAGCCACAACAGTTTGGTGTACAGCAACCCTGTCAGCTCAC
TGGGAAACCCCAACCTATTGCCACTGGCTCACCCTTCTCTGCAGAGGAA
TAGTATGTCTCCTGGTGTAACACATCGACCTCCAAGTGCAGGTAACACA
GGTGGTCTGATGGGTGGAGACCTCACGTCTGGTGCAGGCACCAGTGCAG
GGAACGGGTATGGCAATCCCCGAAACTCACCAGGTCTGCTGGTCTCACC
TGGTAACTTGAACAAGAATATGCAAGCAAAATCTCCTCCCCCAATGAAT
TTAGGAATGAATAACCGTAAACCAGATCTCCGAGTTCTTATTCCACCAG
GCAGCAAGAATACGATGCCATCAGTGTCTGAGGATGTCGACCTGCTTTT
GAATCAAAGGATAAATAACTCCCAGTCGGCTCAGTCATTGGCTACCCCA
GTGGTTTCCGTAGCAACTCCTACTTTACCAGGACAAGGAATGGGAGGAT
ATCCATCAGCCATTTCAACAACATATGGTACCGAGTACTCTCTGAGTAG
TGCAGACCTGTCATCTCTGTCTGGGTTTAACACCGCCAGCGCTCTTCAC
CTTGGTTCAGTAACTGGCTGGCAACAGCAACACCTACATAACATGCCAC
CATCTGCCCTCAGTCAGTTGGGAGCTTGCACTAGCACTCATTTATCTCA
GAGTTCAAATCTCTCCCTGCCTTCTACTCAAAGCCTCAACATCAAGTCA
GAACCTGTTTCTCCTCCTAGAGACCGTACCACCACCCCTTCGAGATACC
CACAACACACGCGCCACGAGGCGGGGAGATCTCCTGTTGACAGCTTGAG
CAGCTGTAGCAGTTCGTACGACGGGAGCGACCGAGAGGATCACCGGAAC
GAATTCCACTCCCCCATTGGACTCACCAGACCTTCGCCGGACGAAAGGG
```

-continued

AAAGTCCCTCAGTCAAGCGCATGCGACTTTCTGAAGGATGGGCAACA, or a nucleic acid sequence that hybridizes to a nucleic acid sequence consisting of SEQ ID NO:180 under stringent hybridization conditions.

In some embodiments, Mohawk (MKX) comprises the amino acid sequence:

(SEQ ID NO: 181; NP_775847)

MNTIVFNKLSSAVLFEDGGASERERGGRPYSGVLDSPHARPEVGIPDGP

PLKDNLGLRHRRTGARQNGGKVRHKRQALQDMARPLKQWLYKHRDNPYP

TKTEKILLALGSQMTLVQVSNWFANARRRLKNTVRQPDLSWALRIKLYN

KYVQGNAERLSVSSDDSCSEDGENPPRTHMNEGGYNTPVHHPVIKSENS

VIKAGVRPESRASEDYVAPPKYKSSLLNRYLNDSLRHVMATNTTMMGKT

RQRNHSGSFSSNEFEEELVSPSSSETEGNFVYRTDTLENGSNKGESAAN

RKGPSKDDTYWKEINAAMALTNLAQGKDKLQGTTSCIIQKSSHIAEVKT

VKVPLVQQF, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:181.

In some embodiments, the nucleic acid sequence encoding MKX comprises the nucleic acid sequence:

(SEQ ID NO: 182; NM_173576)

ATGAACACCATCGTCTTCAACAAGCTCAGCTCTGCGGTGCTGTTTGAGG

ACGGAGGCGCCTCGGAGCGGGAGCGGGGTGGCCGGCCCTACAGCGGTGT

CCTGGACAGTCCTCACGCCCGCCCCGAGGTGGGCATTCCCGACGGCCCG

CCCCTCAAGGACAACCTCGGCCTGAGACACCGGAGGACCGGCGCCCGGC

AGAATGGCGGGAAGGTGAGGCACAAGCGGCAGGCCCTGCAAGACATGGC

GCGACCCCTCAAGCAGTGGCTTTACAAGCACCGTGACAACCCGTACCCC

ACCAAGACCGAGAAGATACTCTTGGCCCTCGGCTCGCAGATGACGCTAG

TGCAGGTGTCAAATTGGTTTGCTAATGCAAGACGTCGGCTTAAGAATAC

CGTTCGACAGCCAGATTTAAGCTGGGCTTTGAGAATAAAGTTATACAAC

AAGTATGTTCAAGGCAATGCTGAACGGCTTAGCGTAAGCAGTGATGACT

CATGTTCTGAAGATGGAGAAAATCCTCCAAGAACCCACATGAACGAAGG

GGGCTATAATACCCCAGTTCACCATCCTGTGATTAAAAGTGAGAATTCG

GTCATCAAAGCGGGAGTGAGGCCAGAGTCACGGGCCAGTGAGGACTACG

TGGCACCCCCCAAATACAAGAGCAGCTTGTTGAACCGTTACCTTAATGA

CTCTTTGAGACATGTCATGGCCACGAACACTACCATGATGGGAAAAACA

AGGCAAAGAAACCACTCGGGATCTTTTAGCTCCAATGAATTTGAGGAAG

AATTAGTGTCTCCATCGTCATCAGAAACTGAAGGCAACTTTGTCTATCG

CACAGACACTCTGGAAAATGGATCCAATAAGGGTGAAAGCGCAGCTAAC

AGAAAAGGACCAAGCAAGGATGACACGTATTGGAAGGAGATCAACGCAG

CTATGGCCTTAACAAATCTTGCACAGGGAAAGGACAAACTGCAGGGAAC

TACCAGCTGCATCATCCAGAAGTCGTCCCATATAGCAGAAGTAAAGACT

-continued

GTCAAAGTGCCGCTGGTGCAGCAGTTT, or a nucleic acid sequence that hybridizes to a nucleic acid sequence consisting of SEQ ID NO:182 under stringent hybridization conditions.

In some embodiments, Iroquois homeobox 1 (IRX1) comprises the amino acid sequence:

(SEQ ID NO: 183; NP_077313)

MSFPQLGYPQYLSAAGPGAYGGERPGVLAAAAAAAAAASSGRPGAAELG

GGAGAAAVTSVLGMYAAAGPYAGAPNYSAFLPYAADLSLFSQMGSQYEL

KDNPGVHPATFAAHTAPAYYPYGQFQYGDPGRPKNATRESTSTLKAWLN

EHRKNPYPTKGEKIMLAIITKMTLTQVSTWFANARRRLKKENKVTWGAR

SKDQEDGALFGSDTEGDPEKAEDDEEIDLESIDIDKIDEHDGDQSNEDD

EDKAEAPHAPAAPSALARDQGSPLAAADVLKPQDSPLGLAKEAPEPGST

RLLSPGAAAGGLQGAPHGKPKIWSLAETATSPDGAPKASPPPPAGHPGA

HGPSAGAPLQHPAFLPSHGLYTCHIGKFSNVVTNSAFLAQGSLLNMRSF

LGVGAPHAAPHGPHLPAPPPPQPPVAIAPGALNGDKASVRSSPTLPERD

LVPRPDSPAQQLKSPFQPVRDNSLAPQEGTPRILAALPSA, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:183.

In some embodiments, the nucleic acid sequence encoding IRX1 comprises the nucleic acid sequence:

(SEQ ID NO: 184; NM_024337)

ATGTCCTTCCCGCAGCTGGGCTACCCGCAGTACCTGAGCGCCGCGGGGC

CGGGCGCCTACGGCGGCGAGCGCCCGGGGGTGCTGGCCGCGGCCGCTGC

GGCGGCTGCCGCCGCCTCGTCGGGCCGACCGGGGGCCGCGGAGCTGGGC

GGCGGGGCAGGCGCGGCTGCAGTCACCTCGGTGCTGGGCATGTACGCGG

CGGCGGGGCCGTACGCGGGCGCGCCCAACTACAGCGCCTTCCTGCCCTA

CGCCGCGGATCTCAGCCTCTTCTCGCAGATGGGCTCGCAGTATGAACTG

AAGGACAACCCTGGGGTGCACCCCGCCACCTTCGCAGCCCACACGGCGC

CGGCTTATTACCCCTACGGCCAGTTCCAATACGGGGACCCCGGGCGGCC

CAAGAACGCCACCCGCGAGAGCACCAGCACGCTCAAGGCCTGGCTCAAC

GAGCACCGCAAGAATCCCTACCCCACCAAGGGCGAGAAGATCATGCTGG

CCATCATCACCAAGATGACCCTCACGCAGGTCTCCACCTGGTTCGCCAA

CGCGCGCCGGCGCCTCAAGAAGGAGAACAAGGTGACATGGGGAGCGCGC

AGCAAGGACCAGGAAGATGGAGCGCTCTTCGGCAGCGACACCGAGGGCG

ACCCGGAGAAGGCCGAGGACGACGAGGAGATCGACCTGGAAAGCATCGA

CATTGACAAGATCGACGAGCACGATGGCGACCAGAGCAACGAGGATGAC

GAGGACAAGGCCGAGGCTCCGCACGCGCCCGCAGCCCCTTCTGCTCTTG

CCCGGGACCAAGGCTCGCCGCTGGCAGCAGCCGACGTTCTCAAGCCCCA

GGACTCGCCCTTGGGCCTGGCAAAGGAGGCCCCAGAGCCGGGCAGCACG

-continued

```
CGCCTGCTGAGCCCCGGCGCTGCAGCGGGCGGCCTGCAGGGTGCGCCGC
ACGGCAAGCCCAAGATCTGGTCGCTGGCGGAGACAGCCACGAGCCCCGA
CGGTGCGCCCAAGGCTTCGCCACCACCACCCGCGGGCCACCCCGGCGCG
CACGGGCCCTCCGCCGGGGCGCCGCTGCAACACCCCGCCTTCCTGCCTA
GCCACGGACTGTACACCTGCCACATCGGCAAGTTCTCCAACTGGACCAA
CAGCGCATTCCTCGCACAGGGCTCCCTGCTCAACATGCGCTCCTTCCTG
GGCGTTGGCGCTCCCCACGCCGCGCCCCATGGCCCTCACCTTCCTGCAC
CTCCACCACCGCAGCCGCCGGTCGCTATTGCCCCGGGGGCACTCAATGG
AGACAAGGCCTCGGTCCGCAGCAGCCCCACGCTCCCAGAGAGAGACCTC
GTCCCCAGGCCAGATTCGCCGGCACAGCAGTTAAAGTCGCCCTTCCAGC
CGGTACGCGACAACTCTCTGGCCCCGCAGGAGGGAACGCCGCGGATCCT
AGCAGCCCTCCCGTCCGCC,
```

or a nucleic acid sequence that hybridizes to a nucleic acid sequence consisting of SEQ ID NO:184 under stringent hybridization conditions.

In some embodiments, iroquois homeobox 2 (IRX2) comprises the amino acid sequence:

```
(SEQ ID NO: 185; NP_150366)
MSYPQGYLYQAPGSLALYSCPAYGASALAAPRSEELARSASGSAFSPYP
GSAAFTAQAATGFGSPLQYSADAAAAAAGFPSYMGAPYDAHTTGMTGAI
SYHPYGSAAYPYQLNDPAYRKNATRDATATLKAWLNEHRKNPYPTKGEK
IMLAIITKMTLTQVSTWFANARRRLKKENKMTWAPRNKSEDEDEDEGDA
TRSKDESPDKAQEGTETSAEDEGISLHVDSLTDHSCSAESDGEKLPCRA
GDPLCESGSECKDKYDDLEDDEDDDEEGERGLAPPKPVTSSPLTGLEAP
LLSPPPEAAPRGGRKTPQGSRTSPGAPPPASKPKLWSLAEIATSDLKQP
SLGPGCGPPGLPAAAAPASTGAPPGGSPYPASPLLGRPLYYTSPFYGNY
TNYGNLNAALQGQGLLRYNSAAAAPGEALHTAPKAASDAGKAGAHPLES
HYRSPGGGYEPKKDASEGCTVVGGGVQPYL,
```

or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:185.

In some embodiments, the nucleic acid sequence encoding IRX2 comprises the nucleic acid sequence:

```
(SEQ ID NO: 186; NM_033267)
ATGTCCTACCCGCAGGGCTACCTGTACCAGGCGCCCGGCTCGCTGGCGC
TCTACTCGTGCCCGGCCTACGGCGCGTCGGCTTTGGCGGCTCCGCGCAG
CGAGGAGCTGGCGCGCTCGGCGTCGGGCTCGGCGTTCAGCCCCTACCCG
GGCTCGGCGGCCTTCACGGCGCAGGCGGCCACCGGCTTCGGGAGCCCGC
TGCAGTACTCGGCCGACGCCGCCGCCGCCGCCGCCGGCTTCCCGTCCTA
CATGGGCGCACCCTACGACGCGCACACCACCGGCATGACCGGCGCCATC
AGCTACCACCCGTACGGCAGCGCGGCCTACCCGTACCAGCTCAACGACC
CCGCGTACCGCAAGAACGCCACGCGGGACGCCACGGCCACTCTCAAGGC
CTGGCTCAACGAGCACCGCAAGAACCCCTACCCCACCAAGGGCGAGAAG
ATCATGCTAGCCATCATCACCAAGATGACCCTCACCCAGGTCTCCACCT
GGTTCGCCAACGCGCGCCGGCGCCTCAAGAAGGAGAACAAGATGACCTG
GGCCCCGAGAAACAAAAGCGAAGATGAGGACGAGGACGAGGGCGACGCT
ACCAGAAGCAAGGACGAGAGTCCCGACAAGGCGCAGGAGGGCACGGAGA
CCTCGGCAGAGGACGAAGGGATCAGCCTGCACGTGGACTCGCTCACGGA
TCACTCGTGCTCGGCCGAGTCGGACGGGGAGAAGCTTCCGTGCCGCGCC
GGGGACCCCCTGTGCGAATCGGGCTCGGAGTGCAAGGACAAGTATGACG
ACCTGGAGGACGACGAGGACGACGACGAGGAGGGCGAGCGGGGCCTGGC
GCCGCCCAAGCCCGTGACCTCGTCGCCGCTTACCGGCTTGGAGGCGCCG
CTGCTGAGCCCCCCGCCCGAGGCCGCGCCCCGCGGTGGCCGCAAGACGC
CCCAGGGCAGCCGGACGTCTCCGGGCGCGCCGCCCCCCGCCAGCAAGCC
CAAGCTGTGGTCGCTGGCCGAGATCGCCACGTCGGACCTCAAGCAGCCG
AGCCTGGGCCCGGGCTGCGGGCCACCGGGGCTGCCCGCGGCCGCCGCGC
CGGCCTCAACCGGGGCACCGCCAGGAGGCTCGCCCTACCCTGCCTCGCC
GCTGCTGGGCCGCCCCCTCTACTACACGTCGCCCTTCTACGGCAACTAC
ACAAACTACGGGAACTTGAACGCGGCGCTGCAGGGCCAGGGTCTCCTGC
GGTACAACTCTGCGGCCGCGGCCCCCGGCGAGGCCCTGCACACCGCGCC
AAAGGCGGCCAGCGACGCGGGCAAGGCGGGCGCGCACCCGCTCGAGTCC
CACTACCGGTCCCCGGGCGGCGGCTACGAGCCCAAGAAAGATGCCAGCG
AGGGCTGCACCGTGGTTGGCGGGGGCGTCCAGCCCTACCTA,
```

or a nucleic acid sequence that hybridizes to a nucleic acid sequence consisting of SEQ ID NO:186 under stringent hybridization conditions.

In some embodiments, iroquois homeobox 3 (IRX3) comprises the amino acid sequence:

```
(SEQ ID NO: 187; NP_077312)
MSFPQLGYQYIRPLYPSERPGAAGGSGGSAGARGGLGAGASELNASGSL
SNVLSSVYGAPYAAAAAAAAQGYGAFLPYAAELPIFPQLGAQYELKDS
PGVQHPAAAAAFPHPHPAFYPYGQYQFGDPSRPKNATRESTSTLKAWLN
EHRKNPYPTKGEKIMLAIITKMTLTQVSTWFANARRRLKKENKMTWAPR
SRTDEEGNAYGSEREEEDEEEDEEDGKRELELEEEELGGEEEDTGGEGL
ADDDEDEEIDLENLDGAATEPELSLAGAARRDGDLGLGPISDSKNSDSE
DSSEGLEDRPLPVLSLAPAPPPVAVASPSLPSPPVSLDPCAPAPAPASA
LQKPKIWSLAETATSPDNPRRSPPGAGGSPPGAAVAPSALQLSPAAAAA
AAHRLVSAPLGKFPAWTNRPFPGPPPGPRPHPLSLLGSAPPHLLGLPGA
AGHPAAAAAFARPAEPEGGTDRCSALEVEKKLLKTAFQPVPRRPQNHLD
AALVLSALSSS,
```

or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:187.

In some embodiments, the nucleic acid sequence encoding IRX3 comprises the nucleic acid sequence (SEQ ID NO: 188; NM_024336)
ATGTCCTTCCCCCAGCTGGGATACCAATACATCCGCCCGCTTTACCCGT
CCGAGCGCCCGGGGGCCGCTGGCGGCAGCGGCGGCAGCGCGGGGGCCCG
GGGCGGCCTGGGTGCCGGAGCCTCGGAGCTGAACGCCTCGGGGTCCCTG
TCCAACGTGCTCTCGTCCGTGTACGGGGCGCCCTACGCCGCGGCCGCTG
CGGCCGCCGCCGCCCAAGGCTACGGCGCCTTCCTGCCCTACGCCGCGGA
GCTGCCCATCTTCCCGCAGCTGGGCGCGCAGTATGAGCTGAAGGACAGC
CCCGGGGTGCAGCATCCGGCCGCGGCTGCCGCGTTTCCGCACCCGCACC
CCGCCTTCTACCCGTATGGCCAGTACCAGTTCGGGGACCCGTCCCGTCC
CAAGAACGCCACCAGGGAGAGCACCAGCACGCTGAAGGCCTGGCTCAAC
GAGCACCGCAAGAACCCCTACCCCACCAAGGGCGAGAAGATCATGCTGG
CCATCATCACCAAGATGACCCTCACCCAGGTGTCCACCTGGTTCGCCAA
CGCGCGCCGGCGCCTCAAGAAGGAGAATAAGATGACTTGGGCGCCTCGC
AGCCGCACTGACGAGGAGGGAAACGCTTATGGGAGCGAGCGCGAGGAGG
AAGACGAAGAGGAGGACGAGGAGGACGGCAAACGCGAGCTAGAGCTGGA
GGAGGAGGAGCTCGGGGGGGAGGAGGAGGACACGGGGGGCGAGGGCCTG
GCTGACGACGACGAGGACGAGGAGATCGATTTGGAGAACTTAGACGGCG
CGGCCACCGAGCCTGAGCTGTCCCTGGCTGGGGCGGCGCGCAGGGATGG
CGACCTAGGCCTGGGACCCATTTCGGACTCCAAAAATAGCGACTCGGAA
GATAGCTCTGAGGGCTTAGAGGACCGGCCACTACCGGTCCTGAGTCTGG
CTCCAGCGCCACCACCAGTGGCCGTGGCCTCGCCGTCTCTGCCGTCGCC
CCCCGTGAGCCTGGACCCCTGCGCTCCCGCACCAGCCCCCGCCTCCGCC
CTGCAGAAGCCCAAGATCTGGTCCCTCGCGGAGACTGCCACAAGCCCGG
ACAACCCGCGCCGCTCGCCTCCCGGCGCGGGGGGGTCTCCACCGGGGGC
AGCGGTCGCGCCTTCCGCCCTGCAGCTCTCTCCGGCCGCCGCCGCCGCC
GCCGCTCACAGACTGGTCTCAGCGCCGCTGGGCAAGTTCCCGGCTTGGA
CCAACCGGCCGTTTCCAGGCCCACCGCCCGGCCCCCGCCCGCACCCGCT
CTCCCTGCTGGGCTCTGCCCCTCCGCACCTGCTGGGACTTCCCGGAGCC
GCGGGCCACCCGGCTGCCGCCGCCGCCTTCGCTCGGCCAGCGGAGCCCG
AAGGCGGAACAGATCGCTGTAGTGCCTTGGAAGTGGAGAAAAAGTTACT
CAAGACAGCTTTCCAGCCCGTGCCCAGGCGGCCCCAGAACCATCTGGAC
GCCGCCCTGGTCTTATCGGCTCTCTCCTCATCC, or a nucleic acid sequence that hybridizes to a nucleic acid sequence consisting of SEQ ID NO:188 under stringent hybridization conditions.

In some embodiments, iroquois homeobox 4 (IRX4) comprises the amino acid sequence:

(SEQ ID NO: 189; NP_057442)
MSYPQFGYPYSSAPQFLMATNSLSTCCESGGRTLADSGPAASAQAPVYC
PVYESRLLATARHELNSAAALGVYGGPYGGSQGYGNYVTYGSEASAFYS
LNSFDSKDGSGSAHGGLAPATAAYYPYEPALGQYPYDRYGTMDSGTRRK

-continued

NATRETTSTLKAWLQEHRKNPYPTKGEKIMLAIITKMTLTQVSTWFANA
RRRLKKENKMTWPPRNKCADEKRPYAEGEEEEGGEEEAREEPLKSSKNA
EPVGKEEKELELSDLDDFDPLEAEPPACELKPPFHSLDGGLERVPAAPD
GPVKEASGALRMSLAAGGGAALDEDLERARSCLRSAAAGPEPLPGAEGG
PQVCEAKLGFVPAGASAGLEAKPRIWSLAHTATAAAAAATSLSQTEFPS
CMLKRQGPAAPAAVSSAPATSPSVALPHSGALDRHQDSPVTSLRNWVDG
VFHDPILRHSTLNQAWATAKGALLDPGPLGRSLGAGANVLTAPLARAFP
PAVPQDAPAAGAARELLALPKAGGKPFCA, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:189.

In some embodiments, the nucleic acid sequence encoding IRX4 comprises the nucleic acid sequence:

(SEQ ID NO: 190: NM_016358)
ATGTCCTACCCGCAGTTTGGATACCCCTACTCCTCGGCTCCCCAGTTCT
TGATGGCCACCAACTCCCTGAGCACGTGCTGCGAGTCCGGAGGCCGCAC
GCTGGCGGACTCCGGGCCCGCCGCCTCGGCCCAGGCGCCGGTCTACTGC
CCGGTCTACGAGAGCCGGCTGCTGGCCACCGCGCGCCACGAGCTCAACT
CGGCCGCGGCGCTGGGCGTCTATGGGGGTCCCTATGGCGGATCGCAGGG
CTATGGCAACTACGTGACCTACGGCTCGGAGGCGTCCGCCTTCTACTCG
CTGAACAGCTTTGATTCCAAGGATGGTTCGGGATCTGCGCATGGGGGCC
TGGCACCAGCCACTGCCGCCTACTACCCTTACGAGCCAGCTCTGGGCCA
GTACCCCTATGACAGGTATGGAACCATGGACAGCGGCACGCGGCGCAAG
AACGCCACGCGCGAGACCACCAGCACGCTCAAGGCCTGGCTGCAGGAGC
ACCGCAAGAACCCCTACCCCACCAAGGGCGAGAAGATCATGCTGGCCAT
CATCACCAAGATGACCCTCACACAGGTCTCCACCTGGTTCGCCAACGCG
CGCCGGCGCCTCAAGAAGGAGAACAAGATGACGTGGCCGCCGCGGAACA
AGTGCGCAGACGAGAAGCGGCCCTACGCGGAGGGCGAGGAGGAGGAGGG
GGGCGAGGAGGAGGCGCGGGAGGAGCCCCTCAAGAGCTCCAAGAACGCA
GAGCCCGTGGGCAAAGAGGAGAAGGAGCTGGAGCTTAGTGACTTGGACG
ACTTCGACCCGCTGGAAGCAGAGCCGCCGGCGTGCGAGCTGAAGCCGCC
CTTCCACTCCCTGGACGGCGGTCTGGAGCGCGTCCCCGCCGCGCCCGAC
GGCCCGGTCAAGGAGGCCTCAGGCGCGCTCCGGATGTCTCTGGCCGCGG
GTGGCGGAGCTGCTCTGGACGAGGACCTGGAGAGGGCCCGGAGCTGTCT
CCGCAGCGCGGCGGCCGGGCCGGAGCCACTGCCGGGCGCAGAGGGCGGC
CCTCAGGTCTGCGAGGCCAAGCTGGGGTTTGTGCCGGCGGGGGCGTCGG
CAGGCCTGGAGGCTAAGCCGCGCATCTGGTCCCTGGCCCACACAGCCAC
CGCCGCCGCCGCCGCCGCCACCTCCCTGAGCCAGACTGAGTTTCCGTCG
TGCATGCTCAAGCGCCAAGGTCCCGCGGCCCCTGCGGCTGTGTCCTCCG
CGCCCGCCACGTCCCCGTCTGTGGCCCTTCCCCACTCTGGCGCCCTGGA

-continued

CAGGCACCAGGACTCCCCGGTAACCAGTCTCAGAAACTGGGTGGACGGG

GTCTTCCACGACCCCATCCTCAGGCACAGCACTTTGAACCAGGCCTGGG

CCACCGCCAAGGGCGCCCTCCTGGACCCCGGGCCTCTGGGACGCTCGCT

GGGGGCGGGCGCGAACGTGCTGACTGCACCCCTGGCCCGCGCCTTTCCG

CCTGCCGTGCCCCAGGACGCCCCAGCTGCAGGCGCCGCCAGGGAGCTGC

TCGCCCTGCCCAAGGCCGGCGGCAAACCCTTCTGCGCC, or a nucleic acid sequence that hybridizes to a nucleic acid sequence consisting of SEQ ID NO:190 under stringent hybridization conditions.

In some embodiments, iroquois homeobox 5 (IRX5) comprises the amino acid sequence:

(SEQ ID NO: 191; NP_005844)

MSYPQGYLYQPSASLALYSCPAYSTSVISGPRTDELGRSSSGSAFSPYA

GSTAFTAPSPGYNSHLQYGADPAAAAAAAFSSYVGSPYDHTPGMAGSLG

YHPYAAPLGSYPYGDPAYRKNATRDATATLKAWLNEHRKNPYPTKGEKI

MLAIITKMTLTQVSTWFANARRRLKKENKMTWTPRNRSEDEEEEENIDL

EKNDEDEPQKPEDKGDPEGPEAGGAEQKAASGCERLQGPPTPAGKETEG

SLSDSDFKEPPSEGRLDALQGPPRTGGPSPAGPAAARLAEDPAPHYPAG

APAPGPHPAAGEVPPGPGGPSVIHSPPPPPPPAVLAKPKLWSLAEIATS

SDKVKDGGGGNEGSPCPPCPGPIAGQALGGSRASPAPAPSRSPSAQCPF

PGGTVLSRPLYYTAPFYPGYTNYGSFGHLHGHPGPGPGPTTGPGSHFNG

LNQTVLNRADALAKDPKMLRSQSQLDLCKDSPYELKKGMSDI, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:191.

In some embodiments, the nucleic acid sequence encoding IRX5 comprises the nucleic acid sequence:

(SEQ ID NO: 192; NM_005853)

ATGTCCTATCCGCAGGGCTACTTGTACCAGCCGTCCGCCTCGCTGGCGC

TCTACTCGTGCCCGGCGTACAGCACCAGCGTCATTTCGGGGCCCCGCAC

GGATGAGCTCGGCCGCTCTTCTTCGGGCTCCGCGTTCTCGCCCTACGCT

GGCTCGACTGCCTTCACGGCGCCCTCGCCGGGCTACAACTCGCACCTCC

AGTACGGCGCCGACCCCGCGGCCGCCGCCGCCGCCGCCTTCTCCTCGTA

CGTGGGCTCTCCCTACGACCACACACCCGGCATGGCGGGCTCCTTGGGG

TACCATCCTTACGCGGCGCCCCTGGGATCGTACCCTTACGGGGACCCAG

CGTACCGGAAGAACGCCACAAGGGACGCCACGGCTACCCTCAAGGCCTG

GCTCAACGAGCACCGCAAGAACCCCTACCCCACCAAGGGCGAGAAGATC

ATGCTGGCCATCATCACCAAGATGACCCTCACCCAGGTGTCCACCTGGT

TCGCCAACGCGCGCCGGCGCCTCAAGAAAGAGAATAAAATGACGTGGAC

GCCGCGGAACCGCAGCGAGGACGAGGAAGAGGAGGAGAACATTGACCTG

GAGAAGAACGACGAGGACGAGCCCCAGAAGCCCGAGGACAAGGGCGACC

CCGAGGGCCCCGAAGCAGGAGGAGCTGAGCAGAAGGCGGCTTCGGGCTG

-continued

CGAACGGCTTCAGGGACCACCCACCCCTGCAGGCAAGGAGACGGAGGGC

AGCCTCAGCGACTCGGATTTTAAGGAGCCGCCCTCGGAGGGCCGCCTCG

ACGCGCTGCAGGGCCCCCCCCGCACCGGCGGGCCCTCCCCGGCTGGGCC

AGCGGCGGCGCGGCTGGCGGAGGACCCGGCCCCTCACTACCCCGCCGGA

GCGCCGGCGCCCGGCCCGCATCCAGCCGCGGGCGAGGTGCCTCCGGGTC

CCGGCGGGCCCTCGGTTATCCATTCGCCGCCTCCGCCGCCGCCTCCTGC

GGTGCTCGCCAAGCCCAAACTGTGGTCTTTGGCAGAGATCGCCACATCG

TCGGACAAGGTCAAGGACGGGGGCGGCGGGAACGAGGGCTCTCCATGCC

CACCGTGTCCCGGGCCCATAGCCGGGCAAGCCCTAGGAGGCAGCCGGGC

GTCGCCGGCCCCGGCGCCGTCACGCTCGCCCTCGGCGCAGTGTCCTTTT

CCAGGCGGGACGGTGCTGTCCCGGCCTCTCTACTACACCGCGCCCTTCT

ATCCCGGCTACACGAACTATGGCTCCTTCGGACACCTTCATGGCCACCC

GGGGCCCGGGCCAGGCCCCACAACCGGTCCGGGGTCTCATTTCAATGGA

TTAAACCAGACCGTGTTGAACCGAGCGGACGCTTTGGCTAAAGACCCGA

AAATGTTGCGGAGCCAGTCTCAGCTAGACCTGTGCAAAGACTCTCCCTA

TGAATTGAAGAAAGGTATGTCCGACATT, or a nucleic acid sequence that hybridizes to a nucleic acid sequence consisting of SEQ ID NO:192 under stringent hybridization conditions.

In some embodiments, iroquois homeobox 6 (IRX6) comprises the amino acid sequence (SEQ ID NO: 193; NP_077311)

MSFPHFGHPYRGASQFLASASSSTTCCESTQRSVSDVASGSTPAPALCC

APYDSRLLGSARPELGAALGIYGAPYAAAAAAQSYPGYLPYSPEPPSLY

GALNPQYEFKEAAGSFTSSLAQPGAYYPYERTLGQYQYERYGAVELSGA

GRRKNATRETTSTLKAWLNEHRKNPYPTKGEKIMLAIITKMTLTQVSTW

FANARRRLKKENKMTWAPKNKGGEERKAEGGEEDSLGCLTADTKEVTAS

QEARGLRLSDLEDLEEEEEEEEEEAEDEEVVATAGDRLTEFRKGAQSLPG

PCAAAREGRLERRECGLAAPRFSFNDPSGSEEADFLSAETGSPRLTMHY

PCLEKPRIWSLAHTATASAVEGAPPARPRPRSPECRMIPGQPPASARRL

SVPRDSACDESSCIPKAFGNPKFALQGLPLNCAPCPRRSEPVVQCQYPS

GAEAG, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:193.

In some embodiments, the nucleic acid sequence encoding IRX6 comprises the nucleic acid sequence:

(SEQ ID NO: 194; NM_024335)

ATGTCCTTCCCACACTTTGGACACCCGTACCGCGGCGCTTCCCAGTTTC

TGGCGTCGGCAAGTTCCAGCACCACATGCTGCGAATCTACCCAACGCTC

TGTCTCAGATGTGGCATCAGGCTCCACCCCAGCGCCCGCTCTCTGCTGC

-continued

```
GCACCCTACGATAGTCGACTGCTGGGCAGTGCGCGACCGGAGCTGGGCG
CCGCCTTGGGCATCTATGGAGCACCCTATGCGGCCGCTGCAGCTGCCCA
GAGCTACCCTGGCTACCTGCCCTATAGCCCAGAGCCCCCCTCACTGTAT
GGGGCACTGAATCCACAGTATGAATTTAAGGAGGCTGCAGGGAGTTTTA
CATCCAGCCTGGCACAACCAGGAGCCTATTATCCCTATGAGCGGACTCT
GGGGCAGTACCAATATGAACGGTATGGCGCAGTGGAATTGAGTGGCGCC
GGTCGCCGAAAGAACGCGACCCGGGAGACCACCAGTACACTCAAGGCCT
GGCTCAACGAGCACCGCAAAAACCCCTACCCCACTAAGGGTGAGAAGAT
CATGCTGGCCATCATCACCAAGATGACCCTCACCCAGGTGTCCACCTGG
TTCGCCAACGCACGCCGGCGCCTCAAGAAAGAGAACAAAATGACATGGG
CGCCCAAGAACAAAGGTGGGGAGGAGAGGAAGGCAGAGGGAGGAGAGGA
GGACTCACTAGGCTGCCTAACTGCTGACACCAAAGAAGTTACTGCTAGC
CAGGAGGCCCGGGGGCTCCGGCTGAGTGACCTGGAAGACCTGGAGGAAG
AGGAGGAGGAGGAGGAGGAAGCTGAAGACGAGGAGGTAGTGGCCACAGC
TGGGGACAGGCTGACGGAGTTCCGAAAGGGCGCGCAGTCACTGCCTGGG
CCGTGCGCTGCAGCTCGAGAGGGCCGATTGGAGCGCAGGGAGTGCGGCC
TGGCTGCGCCCCGCTTCTCCTTCAATGACCCTTCCGGATCGGAAGAAGC
TGACTTCCTCTCGGCGGAGACAGGCAGCCCTAGGTTGACCATGCACTAC
CCATGCTTGGAGAAACCGCGCATCTGGTCTCTGGCGCACACCGCGACAG
CCAGCGCTGTTGAAGGTGCACCCCCAGCCCGGCCTAGGCCACGAAGTCC
TGAGTGCCGTATGATTCCTGGACAGCCTCCTGCCTCTGCCCGGCGACTC
TCAGTCCCCAGAGACTCCGCGTGCGACGAGTCTTCCTGCATACCCAAAG
CCTTTGGAAACCCCAAGTTTGCCCTGCAGGGACTACCGCTGAACTGTGC
GCCGTGCCCGCGGAGGAGCGAGCCTGTAGTGCAGTGCCAGTACCCGTCT
GGAGCAGAAGCAGGT,
```

or a nucleic acid sequence that hybridizes to a nucleic acid sequence consisting of SEQ ID NO:194 under stringent hybridization conditions.

In some embodiments, Scleraxis (SCX) comprises the amino acid sequence:

```
(SEQ ID NO: 195; NP_001073983)
MSFATLRPAPPGRYLYPEVSPLSEDEDRGSDSSGSDEKPCRVHAARCGL
QGARRRAGGRRAGGGGPGGRPGREPRQRHTANARERDRTNSVNTAFTAL
RTLIPTEPADRKLSKIETLRLASSYISHLGNVLLAGEACGDGQPCHSGP
AFFHAARAGSPPPPPPPPPARDGENTQPKQICTFCLSNQRKLSKDRDRK
TAIRS,
```

or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:195.

In some embodiments, the nucleic acid sequence encoding SCX comprises the nucleic acid sequence:

```
(SEQ ID NO: 196; NM_001080514)
ATGTCCTTCGCCACGCTGCGCCCGGCGCCGCCGGGCCGCTACCTGTACC
CCGAGGTGAGCCCGCTGTCGGAGGACGAGGACCGCGGCAGCGACAGCTC
GGGCTCCGACGAGAAACCCTGTCGCGTGCACGCGGCGCGCTGCGGCCTC
CAGGGCGCCCGGCGGAGGGCGGGGGGCCGGCGGGCCGGGGGCGGGGGGC
CAGGGGGCCGGCCAGGCCGTGAGCCCCGGCAGCGGCACACGGCGAACGC
GCGCGAGCGAGACCGCACCAACAGCGTGAACACGGCCTTCACGGCGCTG
CGCACGCTGATCCCCACCGAGCCCGCCGACCGCAAGCTCTCCAAGATTG
AGACGCTGCGCCTGGCCTCCAGCTACATCTCGCACCTGGGCAACGTGCT
GCTGGCGGGCGAGGCCTGCGGCGACGGACAGCCCTGCCACTCCGGGCCC
GCCTTCTTCCACGCGGCGCGCGCCGGCAGCCCCCCGCCGCCGCCCCCGC
CGCCTCCCGCCCGCGACGGCGAGAACACCCAGCCCAAACAGATCTGCAC
CTTCTGCCTCAGCAACCAGAGAAAGTTGAGCAAGGACCGCGACAGAAAG
ACAGCGATTCGCAGT,
```

or a nucleic acid sequence that hybridizes to a nucleic acid sequence consisting of SEQ ID NO:196 under stringent hybridization conditions.

In some embodiments, runt-related transcription factor 1 (RUNX1) comprises the amino acid sequence:

```
(SEQ ID NO: 197; NP_001745)
MASDSIFESFPSYPQCFMRECILGMNPSRDVHDASTSRRFTPPSTALSP
GKMSEALPLGAPDAGAALAGKLRSGDRSMVEVLADHPGELVRTDSPNFL
CSVLPTHWRCNKTLPIAFKVVALGDVPDGTLVTVMAGNDENYSAELRNA
TAAMKNQVARFNDLRFVGRSGRGKSFTLTITVFTNPPQVATYHRAIKIT
VDGPREPRRHRQKLDDQTKPGSLSFSERLSELEQLRRTAMRVSPHHPAP
TPNPRASLNHSTAFNPQPQSQMQDTRQIQPSPPWSYDQSYQYLGSIASP
SVHPATPISPGRASGMTTLSAELSSRLSTAPDLTAFSDPRQFPALPSIS
DPRMHYPGAFTYSPTPVTSGIGIGMSAMGSATRYHTYLPPPYPGSSQAQ
GGPFQASSPSYHLYYGASAGSYQFSMVGGERSPPRILPPCTNASTGSAL
LNPSLPNQSDVVEAEGSHSNSPTNMAPSARLEEAVWRPY,
```

or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:197.

In some embodiments, the nucleic acid sequence encoding RUNX1 comprises the nucleic acid sequence:

```
(SEQ ID NO: 198; NM_001754)
ATGGCTTCAGACAGCATATTTGAGTCATTTCCTTCGTACCCACAGTGCT
TCATGAGAGAATGCATACTTGGAATGAATCCTTCTAGAGACGTCCACGA
TGCCAGCACGAGCCGCCGCTTCACGCCGCCTTCCACCGCGCTGAGCCCA
GGCAAGATGAGCGAGGCGTTGCCGCTGGGCGCCCCGGACGCCGGCGCTG
CCCTGGCCGGCAAGCTGAGGAGCGGCGACCGCAGCATGGTGGAGGTGCT
```

-continued

```
GGCCGACCACCCGGGCGAGCTGGTGCGCACCGACAGCCCCAACTTCCTC
TGCTCCGTGCTGCCTACGCACTGGCGCTGCAACAAGACCCTGCCCATCG
CTTTCAAGGTGGTGGCCCTAGGGGATGTTCCAGATGGCACTCTGGTCAC
TGTGATGGCTGGCAATGATGAAAACTACTCGGCTGAGCTGAGAAATGCT
ACCGCAGCCATGAAGAACCAGGTTGCAAGATTTAATGACCTCAGGTTTG
TCGGTCGAAGTGGAAGAGGGAAAAGCTTCACTCTGACCATCACTGTCTT
CACAAACCCACCGCAAGTCGCCACCTACCACAGAGCCATCAAAATCACA
GTGGATGGGCCCCGAGAACCTCGAAGACATCGGCAGAAACTAGATGATC
AGACCAAGCCCGGGAGCTTGTCCTTTTCCGAGCGGCTCAGTGAACTGGA
GCAGCTGCGGCGCACAGCCATGAGGGTCAGCCCACACCACCCAGCCCCC
ACGCCCAACCCTCGTGCCTCCCTGAACCACTCCACTGCCTTTAACCCTC
AGCCTCAGAGTCAGATGCAGGATACAAGGCAGATCCAACCATCCCCACC
GTGGTCCTACGATCAGTCCTACCAATACCTGGGATCCATTGCCTCTCCT
TCTGTGCACCCAGCAACGCCCATTTCACCTGGACGTGCCAGCGGCATGA
CAACCCTCTCTGCAGAACTTTCCAGTCGACTCTCAACGGCACCCGACCT
GACAGCGTTCAGCGACCCGCGCCAGTTCCCCGCGCTGCCCTCCATCTCC
GACCCCCGCATGCACTATCCAGGCGCCTTCACCTACTCCCCGACGCCGG
TCACCTCGGGCATCGGCATCGGCATGTCGGCCATGGGCTCGGCCACGCG
CTACCACACCTACCTGCCGCCGCCCTACCCCGGCTCGTCGCAAGCGCAG
GGAGGCCCGTTCCAAGCCAGCTCGCCCTCCTACCACCTGTACTACGGCG
CCTCGGCCGGCTCCTACCAGTTCTCCATGGTGGGCGGCGAGCGCTCGCC
GCCGCGCATCCTGCCGCCCTGCACCAACGCCTCCACCGGCTCCGCGCTG
CTCAACCCCAGCCTCCCGAACCAGAGCGACGTGGTGGAGGCCGAGGGCA
GCCACAGCAACTCCCCCACCAACATGGCGCCCTCCGCGCGCCTGGAGGA
GGCCGTGTGGAGGCCCTAC,
```

or a nucleic acid sequence that hybridizes to a nucleic acid sequence consisting of SEQ ID NO:198 under stringent hybridization conditions.

In some embodiments, runt-related transcription factor 2 (RUNX2) comprises the amino acid sequence:

```
                                  (SEQ ID NO: 199; NP_001019801)
MLHSPHKQPQNHKCGANFLQEDSKKSLVFKWLISAGHYQPPRPTESFKA
ASSIYNRGYKFYLKKKGGTMASNSLFSTVTPCQQNFFWDPSTSRRFSPP
SSSLQPGKMSDVSPVVAAQQQQQQQQQQQQQQQQQQQQQQQEAAAAAAA
AAAAAAAAAAVPRLRPPHDNRTMVEIIADHPAELVRTDSPNFLCSVLPS
HWRCNKTLPVAFKVVALGEVPDGTVVTVMAGNDENYSAELRNASAVMKN
QVARFNDLRFVGRSGRGKSFTLTITVFTNPPQVATYHRAIKVTVDGPRE
PRRHRQKLDDSKPSLFSDRLSDLGRIPHPSMRVGVPPQNPRPSLNSAPS
PFNPQGQSQITDPRQAQSSPPWSYDQSYPSYLSQMTSPSIHSTTPLSST
RGTGLPAITDVPRRISDDDTATSDFCLWPSTLSKKSQAGASELGPFSDP
RQFPSISSLTESRFSNPRMHYPATFTYTPPVTSGMSLGMSATTHYHTYL
```

-continued

```
PPPYPGSSQSQSGPFQTSSTPYLYYGTSSGSYQFPMVPGGDRSPSRMLP
PCTTTSNGSTLLNPNLPNQNDGVDADGSHSSSPTVLNSSGRMDESVWRP
Y,
```

or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:199.

In some embodiments, the nucleic acid sequence encoding RUNX2 comprises the nucleic acid sequence

```
                                   (SEQ ID NO: 200; NM_001024630)
ATGCTTCATTCGCCTCACAAACAACCACAGAACCACAAGTGCGGTGCAA
ACTTTCTCCAGGAGGACAGCAAGAAGTCTCTGGTTTTTAAATGGTTAAT
CTCCGCAGGTCACTACCAGCCACCGAGACCAACAGAGTCATTTAAGGCT
GCAAGCAGTATTTACAACAGAGGGTACAAGTTCTATCTGAAAAAAAAAG
GAGGGACTATGGCATCAAACAGCCTCTTCAGCACAGTGACACCATGTCA
GCAAAACTTCTTTTGGGATCCGAGCACCAGCCGGCGCTTCAGCCCCCCC
TCCAGCAGCCTGCAGCCCGGCAAAATGAGCGACGTGAGCCCGGTGGTGG
CTGCGCAACAGCAGCAGCAACAGCAGCAGCAGCAACAGCAGCAGCAGCA
GCAGCAACAGCAGCAGCAGCAGCAGGAGGCGGCGGCGGCGGCTGCGGCG
GCGGCGGCGGCTGCGGCGGCGGCAGCTGCAGTGCCCCGGTTGCGGCCGC
CCCACGACAACCGCACCATGGTGGAGATCATCGCCGACCACCCGGCCGA
ACTCGTCCGCACCGACAGCCCCAACTTCCTGTGCTCGGTGCTGCCCTCG
CACTGGCGCTGCAACAAGACCCTGCCCGTGGCCTTCAAGGTGGTAGCCC
TCGGAGAGGTACCAGATGGGACTGTGGTTACTGTCATGGCGGGTAACGA
TGAAAATTATTCTGCTGAGCTCCGGAATGCCTCTGCTGTTATGAAAAAC
CAAGTAGCAAGGTTCAACGATCTGAGATTTGTGGGCCGGAGTGGACGAG
GCAAGAGTTTCACCTTGACCATAACCGTCTTCACAAATCCTCCCCAAGT
AGCTACCTATCACAGAGCAATTAAAGTTACAGTAGATGGACCTCGGGAA
CCCAGAAGGCACAGACAGAAGCTTGATGACTCTAAACCTAGTTTGTTCT
CTGACCGCCTCAGTGATTTAGGGCGCATTCCTCATCCCAGTATGAGAGT
AGGTGTCCCGCCTCAGAACCCACGGCCCTCCCTGAACTCTGCACCAAGT
CCTTTTAATCCACAAGGACAGAGTCAGATTACAGACCCCAGGCAGGCAC
AGTCTTCCCCGCCGTGGTCCTATGACCAGTCTTACCCCTCCTACCTGAG
CCAGATGACGTCCCCGTCCATCCACTCTACCACCCCGCTGTCTTCCACA
CGGGGCACTGGGCTTCCTGCCATCACCGATGTGCCTAGGCGCATTTCAG
ATGATGACACTGCCACCTCTGACTTCTGCCTCTGGCCTTCCACTCTCAG
TAAGAAGAGCCAGGCAGGTGCTTCAGAACTGGGCCCTTTTTCAGACCCC
AGGCAGTTCCCAAGCATTTCATCCCTCACTGAGAGCCGCTTCTCCAACC
CACGAATGCACTATCCAGCCACCTTTACTTACACCCCGCCAGTCACCTC
AGGCATGTCCCTCGGTATGTCCGCCACCACTCACTACCACACCTACCTG
CCACCACCCTACCCCGGCTCTTCCCAAAGCCAGAGTGGACCCTTCCAGA
CCAGCAGCACTCCATATCTCTACTATGGCACTTCGTCAGGATCCTATCA
```

-continued

GTTTCCCATGGTGCCGGGGGGAGACCGGTCTCCTTCCAGAATGCTTCCG

CCATGCACCACCACCTCGAATGGCAGCACGCTATTAAATCCAAATTTGC

CTAACCAGAATGATGGTGTTGACGCTGATGGAAGCCACAGCAGTTCCCC

AACTGTTTTGAATTCTAGTGGCAGAATGGATGAATCTGTTTGGCGACCA

TAT, or a nucleic acid sequence that hybridizes to a nucleic acid sequence consisting of SEQ ID NO:200 under stringent hybridization conditions.

In some embodiments, runt-related transcription factor 3 (RUNX3) comprises the amino acid sequence:

(SEQ ID NO: 201; NP_001026850)

MASNSIFDSFPTYSPTFIRDPSTSRRFTPPSPAFPCGGGGGKMGENSGA

LSAQAAVGPGGRARPEVRSMVDVLADHAGELVRTDSPNFLCSVLPSHWR

CNKTLPVAFKVVALGDVPDGTVVTVMAGNDENYSAELRNASAVMKNQVA

RFNDLRFVGRSGRGKSFTLTITVFTNPTQVATYHRAIKVTVDGPREPRR

HRQKLEDQTKPFPDRFGDLERLRMRVTPSTPSPRGSLSTTSHFSSQPQT

PIQGTSELNPFSDPRQFDRSFPTLPTLTESRFPDPRMHYPGAMSAAFPY

SATPSGTSISSLSVAGMPATSRFHHTYLPPPYPGAPQNQSGPFQANPSP

YHLYYGTSSGSYQFSMVAGSSSGGDRSPTRMLASCTSSAASVAAGNLMN

PSLGGQSDGVEADGSHSNSPTALSTPGRMDEAVWRPY, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:201.

In some embodiments, the nucleic acid sequence encoding RUNX3 comprises the nucleic acid sequence:

(SEQ ID NO: 202; NM_001031680)

ATGGCATCGAACAGCATCTTCGACTCCTTCCCGACCTACTCGCCGACCT

TCATCCGCGACCCAAGCACCAGCCGCCGCTTCACACCTCCCTCCCCGGC

CTTCCCCTGCGGCGGCGGCGGCGGCAAGATGGGCGAGAACAGCGGCGCG

CTGAGCGCGCAGGCGGCCGTGGGGCCCGGAGGGCGCGCCCGGCCCGAGG

TGCGCTCGATGGTGGACGTGCTGGCGGACCACGCAGGCGAGCTCGTGCG

CACCGACAGCCCCAACTTCCTCTGCTCCGTGCTGCCCTCGCACTGGCGC

TGCAACAAGACGCTGCCCGTCGCCTTCAAGGTGGTGGCATTGGGGGACG

TGCCGGATGGTACGGTGGTGACTGTGATGGCAGGCAATGACGAGAACTA

CTCCGCTGAGCTGCGCAATGCCTCGGCCGTCATGAAGAACCAGGTGGCC

AGGTTCAACGACCTTCGCTTCGTGGGCCGCAGTGGGCGAGGGAAGAGTT

TCACCCTGACCATCACTGTGTTCACCAACCCCACCCAAGTGGCGACCTA

CCACCGAGCCATCAAGGTGACCGTGGACGGACCCCGGGAGCCCAGACGG

CACCGGCAGAAGCTGGAGGACCAGACCAAGCCGTTCCCTGACCGCTTTG

GGGACCTGGAACGGCTGCGCATGCGGGTGACACCGAGCACACCCAGCCC

CCGAGGCTCACTCAGCACCACAAGCCACTTCAGCAGCCAGCCCCAGACC

-continued

CCAATCCAAGGCACCTCGGAACTGAACCCATTCTCCGACCCCCGCCAGT

TTGACCGCTCCTTCCCCACGCTGCCAACCCTCACGGAGAGCCGCTTCCC

AGACCCCAGGATGCATTATCCCGGGGCCATGTCAGCTGCCTTCCCCTAC

AGCGCCACGCCCTCGGGCACGAGCATCAGCAGCCTCAGCGTGGCGGGCA

TGCCGGCCACCAGCCGCTTCCACCATACCTACCTCCCGCCACCCTACCC

GGGGGCCCCGCAGAACCAGAGCGGGCCCTTCCAGGCCAACCCGTCCCCC

TACCACCTCTACTACGGGACATCCTCTGGCTCCTACCAGTTCTCCATGG

TGGCCGGCAGCAGCAGTGGGGGCGACCGCTCACCTACCCGCATGCTGGC

CTCTTGCACCAGCAGCGCTGCCTCTGTCGCCGCCGGCAACCTCATGAAC

CCCAGCCTGGGCGGCCAGAGTGATGGCGTGGAGGCCGACGGCAGCCACA

GCAACTCACCCACGGCCCTGAGCACGCCAGGCCGCATGGATGAGGCCGT

GTGGCGGCCCTAC, or a nucleic acid sequence that hybridizes to a nucleic acid sequence consisting of SEQ ID NO:202 under stringent hybridization conditions.

In some embodiments, Paired box 9 (PAX9) comprises the amino acid sequence:

(SEQ ID NO: 203; NP_001359005.1)

MEPAFGEVNQLGGVFVNGRPLPNAIRLRIVELAQLGIRPCDISRQLRVS

HGCVSKILARYNETGSILPGAIGGSKPRVTTPTVVKHIRTYKQRDPGIF

AWEIRDRLLADGVCDKYNVPSVSSISRILRNKIGNLAQQGHYDSYKQHQ

PTPQPALPYNHIYSYPSPITAAAAKVPTPPGVPAIPGSVAMPRTWPSSH

SVTDILGIRSITDQVSDSSPYHSPKVEEWSSLGRNNFPAAAPHAVNGLE

KGALEQEAKYGQAPNGLPAVGSFVSASSMAPYPTPAQVSPYMTYSAAPS

GYVAGHGWQHAGGTSLSPHNCDIPASLAFKGMQAAREGSHSVTASAL, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:203.

In some embodiments, the nucleic acid sequence encoding PAX9 comprises the nucleic acid sequence:

(SEQ ID NO: 204; NM_001372076.1)

AGCCCAGCCCACGTTGCTGCTTAGATTGAAATGCAGAACTCAAGCCTCT

TTCATCGGGGCACAGACTTCCTTTTACTTCTTCCTTTTGCCCTCTCGCC

TCCTCCTCCTGGGAAGAAGCGGAGGCGCCGGCGGTCGGCCGGGATAGCA

ACAGGCCGGGCCACTGAGGCGGTGCGGAAAGTTTCTGTCTGGGAGTGCG

GAACTGGGGCCGGGTTGGTGTACTGCTCGGAGCAATGGAGCCAGCCTTC

GGGGAGGTGAACCAGCTGGGAGGAGTGTTCGTGAACGGGAGGCCGCTGC

CCAACGCCATCCGGCTTCGCATCGTGGAACTGGCCCAACTGGGCATCCG

ACCGTGTGACATCAGCCGCCAGCTACGGGTCTCGCACGGCTGCGTCAGC

AAGATCCTGGCGCGATACAACGAGACGGGCTCGATCTTGCCAGGAGCCA

TCGGGGGCAGCAAGCCCCGGGTCACTACCCCCACCGTGGTGAAACACAT

CCGGACCTACAAGCAGAGAGACCCCGGCATCTTCGCCTGGGAGATCCGG

-continued

GACCGCCTGCTGGCGGACGGCGTGTGCGACAAGTACAATGTGCCCTCCG
TGAGCTCCATCAGCCGCATTCTGCGCAACAAGATCGGCAACTTGGCCCA
GCAGGGTCATTACGACTCATACAAGCAGCACCAGCCGACGCCGCAGCCA
GCGCTGCCCTACAACCACATCTACTCGTACCCCAGCCCTATCACGGCGG
CGGCCGCCAAGGTGCCCACGCCACCCGGGGTGCCTGCCATCCCCGGTTC
GGTGGCCATGCCGCGCACCTGGCCCTCCTCGCACTCCGTCACCGACATC
CTGGGCATCCGCTCCATCACCGACCAAGTGAGCGACAGCTCCCCCTACC
ACAGCCCCAAGGTGGAGGAGTGGAGCAGCCTGGGCCGCAACAACTTCCC
CGCCGCCGCCCCGCACGCGGTGAACGGGTTGGAGAAGGGAGCCCTGGAG
CAGGAAGCCAAGTACGGTCAGGCACCAAATGGTCTCCCAGCTGTGGGCA
GTTTTGTGTCAGCATCCAGCATGGCTCCTTACCCTACCCCAGCCCAAGT
GTCGCCTTACATGACCTACAGTGCTGCTCCTTCTGGTTATGTTGCTGGA
CATGGGTGGCAACATGCTGGGGGCACCTCATTGTCTCCCCACAACTGTG
ACATTCCGGCATCGCTGGCGTTCAAGGGAATGCAGGCAGCCAGAGAAGG
TAGTCATTCTGTCACGGCTTCCGCGCTCTGATGGGAAATTCCGTCTCCA
GCAGCTTCACCCGGGTCTCCCTGTCTCAGCACCTCCTCCCCCAATTCCC
AGGTCTCACATCCCACCCCTCCTGCCCTCCAACCCTTCTGCCTTGAAAG
CTGGCTGTACGGACTCACATCCTTTGTGCTAATGACACTTACATATTTC
TTGCCATAACTTTTCTCTTGCAGAAAAACTGACATGACTTTAGGATTTA
AAAACAAGAGCAACAATAAGCATTGAATGAGACATTTGTGTTGCCCACA
TACTGTCTTAACATAACAAAGAAACCTACACCCCTCAAAGGGTTTAAGG
AACTTTACAAACTAGTCTTTGGTAAAACCACATGTGTATATTTATTCTA
AATCAACCTGAACTTTTGAAATGTGCAATTGTTGAGATTTTGCAAAATC
AATAAAGGAAAATACTTATAGAAAAAATTATGCTACACCCTCTAATCAA
ATATGGTAACCAAGTAAGCTTTAATTCATCATTAGGAAACAAATCAATA
AGTGACTTGTTTGAGTGATCCTTTGTTTAAGACATGACCTATTTTGTTG
AAAAATATATGTAGAACCCAAGCAATATCTGAATCTAGCTCTCCCTGGT
GTTTTGACTTGGTTCCAAATACAATAATGTTTATATTTTCTATTAGTTT
GTAAATACGGACTCTGGATGGTGCATTTGTGTCTTCATTCCATAAGATA
TTCCCCTCCCCTCAGCCCCACCCCCTCTCTATTTTTTTTCTTTCTTTTTT
GCAAAGGTGACTTTCTGGCAACGTCTTTGTCTCTGTTTGGTGGTGGGCT
GCTCGGGCTCCTGGACCTGGACTTGCCCCCAAATTTTGTGTATGCAGTG
AAGGCTTCAACATCTCATGAAGGACACTTTATTTCTACAGCAGAGGACA
CGAAAAACAGATAAAACAAGCCAGTCTCCCATTTTGTACCTAATCAAAC
AACACACATGCTAAGCATATAAAGACAAGAGGGTGGAAAATATCTGAAC
AAGAAGGCTCTAAAGGAAGTCACTTAGAAACTTAAGTTTAATGTGAAAT
GTTTTGCAAAGATGCTTAAAATGAACTTTGTGTTAAGAAAACCACTGTG
AAACTAAATTGTCCTATTATTGTTGGCTTACCTGTGTGTTCAGCAATCT
CAGCCCCAAATAATGTTGTAATTTAAAGAAAATGGAAAATTCTGCTCTA
ATGAATGTAACAATGGCTTGCTGTGAAGTTTACATTGTTGTACAGAAGC

-continued

ATGTTTCGCATGTAGGTAAACTGGTGGTGGTACTAGAAATACAATGTTA
TTTAATTTTAACAAATTCCCTTTATTCATTTCTGAAATTACAGGACACA
GTTTAACTCATAAACCTTTCTAGACCAATTTATTTTTCACTTTAATGTT
AATAACAGTTGTGGAGTATATGTGTGTGTGAGCATGTGAGTATGTGTTG
TATTTTAAAACAATTGATTTTCTGGGGCAAAATTCTACAGTTTTTAATC
CCTTCTGTTTAGGAAGTTCTTCCTGTTTGGCAATATAGGCTTAAAAATA
TGTTTTTAGGACATTGGTACAATTCAGCTGTTGGAAAATTAATATATTG
AGGGTTTTTTGGTACTAATTCTGTGCAATAACTAAAAGAGCACCTCACT
GGATATGGATGTTGAAGATGGATTCCCTAGGTGATTTTAATTTCTTCCG
GTCTGTGCTGTGCACAGTCTACATGGCAATGCGGTTCCACCACATCGGT
TTCGTGGCTTCGTTTAAAACTCAGATGGCTAGATTAGTTAGGTTTTCAA
ATCACTAGGATGTAAACAGTAAGCAGATTTCTGACACACAAATTATGTT
AGAGTGACTGCTTTTTTCAGACAGCAGATATCTTATAGAGAGCTTTGAA
CTGCATTTATTTCTAAAGCAACCGAAATTCAGTGCTACAAATAGAGGAT
TATAACTTCAGGAGAAGAATAAGCAGAAGGAGCAGATGAACTCTCAGGG
CCATAGTCTTCCTTTGATCTTGTAAAACTTCCATTGACATCTGGAGTTC
CCAGTCTGGTGAGAAAATAGACTATAAACTGAATGGAACAAAGATCCAA
TCCAATATTTTGGTGGAGACTTCTTTAAAACCATACCATACAGGGACTC
TCCTGTCATCTGAAAAACTGATGTAAGGTACAGAACTATTCTTTATCAA
ATGTTTTTAGGTGGCTGTTAGGGGGCTTTAAAAAATATTACTTGCTTGT
GTGGAAATGCAAATAATGTTATTTTCTTTATCTAAATTAAGAAATCTCT
TGTTATTGTGCTATTTATAATTTTTTTCTGGTTCTTGTATTTTAAAAAA
TCTAATATTAATGGTATTGAAGTTTCCTTTTCTCCCTCTAGGTCTTAAC
AGTGAATTCACATGGAGTAATTTTTAAAAGATATCAGATACAATTTGCT
ATTCAAAGAAAATTATGATTTAAAGCCACTTTTTAAAATACGAGAAGGA
AAATAGGATGGATTAAAGGGTTAACTTTTAAAGATTATTATTGGTTAAT
GTTGACATATTTCCTCTATCTCATAGATGGTAAAAGTGTTGCTTTTAAA
CTGGCAAATGCACTCTTCAGAAATCCTTTTCTATCTGATCCACATGGAG
AGGTTAAAGGTTCAATTTCATGACCTCTATGCAGGCAGCGCTCTCATTG
GATGTAAGAATATTACCTGCAAGGATAGAATGCAGTTGTGCAACAGAGA
CACATTCTTATTTCTTTTTTTTCACAATTTTGTTTTGTTTTTAATGACC
CTTTTATTGAATATTGGACTGAAATATAAATTTTAAAAAACACGTTGGA
AAGGATGTACAACAGAAGGCTATGTATGTATATACAGTATGTCAAAAGC
CTTTTATTTTTATACTTCAAATGCTCTAAATTAATAAAAAGTAATAATT
A, or a nucleic acid sequence that hybridizes to a nucleic acid sequence consisting of SEQ ID NO:204 under stringent hybridization conditions.

In some embodiments, Homeobox Protein Nkx-3.2 (Nkx-3.2) comprises the amino acid sequence:

(SEQ ID NO: 205; NP_001180.1)
MAVRGANTLTSFSIQAILNKKEERGGLAAPEGRPAPGGTAASVAAAPAV
CCWRLFGERDAGALGGAEDSLLASPAGTRTAAGRTAESPEGWDSDSALS
EENESRRRCADARGASGAGLAGGSLSLGQPVCELAASKDLEEEAAGRSD
SEMSASVSGDRSPRTEDDGVGPRGAHVSALCSGAGGGGGSGPAGVAEEE
EEPAAPKPRKKRSRAAFSHAQVFELERRFNHQRYLSGPERADLAASLKL
TETQVKIWFQNRRYKTKRRQMAADLLASAPAAKKVAVKVLVRDDQRQYL
PGEVLRPPSLLPLQPSYYYPYYCLPGWALSTCAAAAGTQ, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:205

In some embodiments, the nucleic acid sequence encoding Nkx-3.2 comprises the nucleic acid sequence:

(SEQ ID NO: 206; NM_001189.4)
ACTCGCGCTGCGGCCGCCGGCGCTCTCTGTCCCGCTCGGAGCTGCTCGG
CGCCCCAGCTGCCCGCCCCGCCGGCCGCTCCTGCCCGCGGCGCAGATGG
CTGTGCGCGGCGCCAACACCTTGACGTCCTTCTCCATCCAGGCGATCCT
CAACAAGAAAGAGGAGCGCGGCGGGCTGGCCGCGCCAGAGGGGCGCCCG
GCGCCCGGGGGCACAGCGGCATCGGTGGCCGCGGCTCCCGCTGTCTGCT
GTTGGCGGCTCTTTGGGGAGAGGGACGCGGGCGCGTTGGGGGGCGCCGA
GGACTCTCTGCTGGCGTCTCCTGCCGGTACCAGAACAGCTGCGGGGCGG
ACTGCGGAGAGCCCGGAAGGCTGGGACTCGGACTCCGCGCTCAGCGAGG
AGAACGAGAGCAGGCGGCGCTGCGCGGACGCGCGGGGGGCCAGCGGGGC
CGGCCTTGCGGGGGGATCCTTGAGCCTCGGCCAGCCGGTCTGTGAGCTG
GCCGCTTCCAAAGACCTAGAGGAGGAAGCCGCGGGCCGGAGCGACAGCG
AGATGTCCGCCAGCGTCTCAGGCGACCGCAGCCCAAGGACCGAGGACGA
CGGTGTTGGCCCCAGAGGTGCACACGTGTCCGCGCTGTGCAGCGGGGCC
GGCGGCGGGGGCGGCAGCGGGCCGGCAGGCGTCGCGGAGGAGGAGGAGG
AGCCGGCGGCGCCCAAGCCACGCAAGAAGCGCTCGCGGGCCGCTTTCTC
CCACGCGCAGGTCTTCGAGCTGGAGCGCCGCTTTAACCACCAGCGCTAC
CTGTCCGGGCCCGAGCGCGCAGACCTGGCCGCGTCGCTGAAGCTCACCG
AGACGCAGGTGAAAATCTGGTTCCAGAACCGTCGCTACAAGACAAAGCG
CCGGCAGATGGCAGCCGACCTGCTGGCCTCGGCGCCCGCCGCCAAGAAG
GTGGCCGTAAAGGTGCTGGTGCGCGACGACCAGAGACAATACCTGCCCG
GCGAAGTGCTGCGGCCACCCTCGCTTCTGCCACTGCAGCCCTCCTACTA
TTACCCGTACTACTGCCTCCCAGGCTGGGCGCTCTCCACCTGCGCAGCT
GCCGCAGGCACCCAGTGAACCCGCTTGGGCTGAGGCAGCGAGTGATTCC
CGCGCTCCGGCTCCGGACCGGCGCTGACAGCTGTAGGCTGTAGCCTGCA
CGGGGCGCCCCGCCAAGGAGGCACCTGGAGGTGAAACCCAGCTCCAGCT

-continued
CCCGTTAGCCAGGACTTGTCCCCTGGCAGCTGGGCTGAGTCTGCCCTGA
GGGGGCGCCTTTTTCTAATTTGAACAGAGGCACCCTATGGCCTAGGGGC
CCTGATCGCCCACCTGCCTGGAAGCCCCTGGGCTCTATTTATTATCATG
ACAATGTTGGAATTAAATTTTGATTCGAATATGTCTGCCTGGGGGTGGG
GTTTTCCCTGAGCGGCAACTCCTGGAGACCACATAGCCTGAATCCTCAG
AATTTCAGGCCTGCTGGGAGCTTTCTGCACTAGGCCACACTAGTTCATG
GTATCCATGCTACCAATCTATGTGTATCTACATATCTTTTATTTTTGGA
AATTGCATTTGTAACCAAGGGGTGCGAAACCCTGGCAGTCCCAGGCAGC
ACCAGGCCAGGGGTTGATTTGAAACGTGAAGGATTGGGTTTTCAGGCCC
TCTGCTCCACCCCTCCTGTGTGTCAGAGCTAGGGTGGGGGTGCCCGATT
CGGGTGCTGAATGTAAGGAGGGGAGCCTCCAAGTGTGGTGCAAGCCGGG
GGTCTCCACATCTTCCTTCTCTGAAGTCCAGGTACCTGCACAAGCAGGA
AGCGCCTGGGAGTCCCGGAAGGAGGAGAGCGCACACCCAGGCAGCCCTC
TGCGGAAACTTTCCTTGGTTTCTTTTTATTTGTGTAAAGGAGGTTAAGA
CGTGTCGCACTTTTCAGTTGTTTGTATTCAAATGACGATTATTTTTCTA
CTCAATGTGAATATCCCTGGCCAGCCTTTCCACGGCGCCCACCGCAGTG
CCGCTGCCTGGCCCTCAGTGTCTACCTTCTGCCCTCTGCGACTCCAGTG
CTCTGGCCCGGGACTCCCCTATCCGCCCCTCACTTACCCTTAAACAGGT
GATCCCACCTGTCTTGTCAACCTCGCCGCTTTTCGCCTCCTTAATGGCA
CTGTGCACTCAACTAGAGTATTAACTGTAAAAAGATTTGTGAAGTTTGG
AAGCTCTATTCGCTGTATTTTTTCTTTAATTTATAAACTTTTAGTTTAA
CATGC, or a nucleic acid sequence that hybridizes to a nucleic acid sequence consisting of SEQ ID NO:206 under stringent hybridization conditions.

In some embodiments, AP-1 transcription factor (FOS, C-FOX, AP-1, p55) comprises the amino acid sequence:

(SEQ ID NO: 207; NP_005243.1)
MMFSGFNADYEASSSRCSSASPAGDSLSYYHSPADSFSSMGSPVNAQDF
CTDLAVSSANFIPTVTAISTSPDLQWLVQPALVSSVAPSQTRAPHPFGV
PAPSAGAYSRAGVVKTMTGGRAQSIGRRGKVEQLSPEEEEKRRIRRERN
KMAAAKCRNRRRELTDTLQAETDQLEDEKSALQTEIANLLKEKEKLEFI
LAAHRPACKIPDDLGFPEEMSVASLDLTGGLPEVATPESEEAFTLPLLN
DPEPKPSVEPVKSISSMELKTEPFDDFLFPASSRPSGSETARSVPDMDL
SGSFYAADWEPLHSGSLGMGPMATELEPLCTPVVTCTPSCTAYTSSFVF
TYPEADSFPSCAAAHRKGSSSNEPSSDSLSSPTLLAL, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:207)

In some embodiments, the nucleic acid sequence encoding FOS comprises the nucleic acid sequence:

(SEQ ID NO: 208; NM_005252.4)

AACCGCATCTGCAGCGAGCATCTGAGAAGCCAAGACTGAGCCGGCGGCC

GCGGCGCAGCGAACGAGCAGTGACCGTGCTCCTACCCAGCTCTGCTCCA

CAGCGCCCACCTGTCTCCGCCCCTCGGCCCCTCGCCCGGCTTTGCCTAA

CCGCCACGATGATGTTCTCGGGCTTCAACGCAGACTACGAGGCGTCATC

CTCCCGCTGCAGCAGCGCGTCCCCGGCCGGGGATAGCCTCTCTTACTAC

CACTCACCCGCAGACTCCTTCTCCAGCATGGGCTCGCCTGTCAACGCGC

AGGACTTCTGCACGGACCTGGCCGTCTCCAGTGCCAACTTCATTCCCAC

GGTCACTGCCATCTCGACCAGTCCGGACCTGCAGTGGCTGGTGCAGCCC

GCCCTCGTCTCCTCCGTGGCCCCATCGCAGACCAGAGCCCCTCACCCTT

TCGGAGTCCCCGCCCCCTCCGCTGGGGCTTACTCCAGGGCTGGCGTTGT

GAAGACCATGACAGGAGGCCGAGCGCAGAGCATTGGCAGGAGGGGCAAG

GTGGAACAGTTATCTCCAGAAGAAGAAGAGAAAAGGAGAATCCGAAGGG

AAAGGAATAAGATGGCTGCAGCCAAATGCCGCAACCGGAGGAGGGAGCT

GACTGATACACTCCAAGCGGAGACAGACCAACTAGAAGATGAGAAGTCT

GCTTTGCAGACCGAGATTGCCAACCTGCTGAAGGAGAAGGAAAAACTAG

AGTTCATCCTGGCAGCTCACCGACCTGCCTGCAAGATCCCTGATGACCT

GGGCTTCCCAGAAGAGATGTCTGTGGCTTCCCTTGATCTGACTGGGGGC

CTGCCAGAGGTTGCCACCCCGGAGTCTGAGGAGGCCTTCACCCTGCCTC

TCCTCAATGACCCTGAGCCCAAGCCCTCAGTGGAACCTGTCAAGAGCAT

CAGCAGCATGGAGCTGAAGACCGAGCCCTTTGATGACTTCCTGTTCCCA

GCATCATCCAGGCCCAGTGGCTCTGAGACAGCCCGCTCCGTGCCAGACA

TGGACCTATCTGGGTCCTTCTATGCAGCAGACTGGGAGCCTCTGCACAG

TGGCTCCCTGGGGATGGGGCCCATGGCCACAGAGCTGGAGCCCCTGTGC

ACTCCGGTGGTCACCTGTACTCCCAGCTGCACTGCTTACACGTCTTCCT

TCGTCTTCACCTACCCCGAGGCTGACTCCTTCCCCAGCTGTGCAGCTGC

CCACCGCAAGGGCAGCAGCAGCAATGAGCCTTCCTCTGACTCGCTCAGC

TCACCCACGCTGCTGGCCCTGTGAGGGGGCAGGGAAGGGGAGGCAGCCG

GCACCCACAAGTGCCACTGCCCGAGCTGGTGCATTACAGAGAGGAGAAA

CACATCTTCCCTAGAGGGTTCCTGTAGACCTAGGGAGGACCTTATCTGT

GCGTGAAACACACCAGGCTGTGGGCCTCAAGGACTTGAAAGCATCCATG

TGTGGACTCAAGTCCTTACCTCTTCCGGAGATGTAGCAAAACGCATGGA

GTGTGTATTGTTCCCAGTGACACTTCAGAGAGCTGGTAGTTAGTAGCAT

GTTGAGCCAGGCCTGGGTCTGTGTCTCTTTTCTCTTTCTCCTTAGTCTT

CTCATAGCATTAACTAATCTATTGGGTTCATTATTGGAATTAACCTGGT

GCTGGATATTTTCAAATTGTATCTAGTGCAGCTGATTTTAACAATAACT

ACTGTGTTCCTGGCAATAGTGTGTTCTGATTAGAAATGACCAATATTAT

ACTAAGAAAAGATACGACTTTATTTTCTGGTAGATAGAAATAAATAGCT

ATATCCATGTACTGTAGTTTTTCTTCAACATCAATGTTCATTGTAATGT

-continued

TACTGATCATGCATTGTTGAGGTGGTCTGAATGTTCTGACATTAACAGT

TTTCCATGAAAACGTTTTATTGTGTTTTTAATTTATTTATTAAGATGGA

TTCTCAGATATTTATATTTTTATTTTATTTTTTTCTACCTTGAGGTCTT

TTGACATGTGGAAAGTGAATTTGAATGAAAAATTTAAGCATTGTTTGCT

TATTGTTCCAAGACATTGTCAATAAAAGCATTTAAGTTGAATGCGA, or a nucleic acid sequence that hybridizes to a nucleic acid sequence consisting of SEQ ID NO:208 under stringent hybridization conditions.

In some embodiments, FosB proto-oncogene (FosB, GOS3, G0S3, GOSB) comprises the amino acid sequence: MFQAFPGDYDSGSRCSSSP-SAESQYLSSVDSFGSPPTAAASQECAGLGEMPGSFV PT VTAITTSQDLQWLVQPTLISSMAQSQGQ-PLASQPPVVDPYDMPGTSYSTPGMSGYSS GGASGSGGPSTSGTTSGPGPARPARARPRRPREET-ETDQLEEEKAELESEIAELQKEK ERLEFVL-VAHKPGCKIPYEEGPGPGP-LAEVRDLPGSAPAKEDGFSWLLPPPPPPLPF QTSQDAPPNLTASLFTHSEVQVLGDPFPVVNP-SYTSSFVLTCPEVSAFAGAQRTSGSD QPSDPLNSPSL-LAL. (SEQ ID NO:209; NP_001107643.1), or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:209)

In some embodiments, the nucleic acid sequence encoding FosB comprises the nucleic acid sequence:

(SEQ ID NO: 210; NM_001114171.2)

ATTCATAAGACTCAGAGCTACGGCCACGGCAGGGACACGCGGAACCAAG

ACTTGGAAACTTGATTGTTGTGGTTCTTCTTGGGGGTTATGAAATTTCA

TTAATCTTTTTTTTTCCGGGGAGAAAGTTTTTGGAAAGATTCTTCCAGA

TATTTCTTCATTTTCTTTTGGAGGACCGACTTACTTTTTTTGGTCTTCT

TTATTACTCCCCTCCCCCCGTGGGACCCGCCGGACGCGTGGAGGAGACC

GTAGCTGAAGCTGATTCTGTACAGCGGGACAGCGCTTTCTGCCCCTGGG

GGAGCAACCCCTCCCTCGCCCCTGGGTCCTACGGAGCCTGCACTTTCAA

GAGGTACAGCGGCATCCTGTGGGGGCCTGGGCACCGCAGGAAGACTGCA

CAGAAACTTTGCCATTGTTGGAACGGGACGTTGCTCCTTCCCCGAGCTT

CCCCGGACAGCGTACTTTGAGGACTCGCTCAGCTCACCGGGGACTCCCA

CGGCTCACCCCGGACTTGCACCTTACTTCCCCAACCCGGCCATAGCCTT

GGCTTCCCGGCGACCTCAGCGTGGTCACAGGGGCCCCCCTGTGCCCAGG

GAAATGTTTCAGGCTTTCCCCGGAGACTACGACTCCGGCTCCCGGTGCA

GCTCCTCACCCTCTGCCGAGTCTCAATATCTGTCTTCGGTGGACTCCTT

CGGCAGTCCACCCACCGCCGCCGCCTCCCAGGAGTGCGCCGGTCTCGGG

GAAATGCCCGGTTCCTTCGTGCCCACGGTCACCGCGATCACAACCAGCC

AGGACCTCCAGTGGCTTGTGCAACCCACCCTCATCTCTTCCATGGCCCA

GTCCCAGGGGCAGCCACTGGCCTCCCAGCCCCCGGTCGTCGACCCCTAC

GACATGCCGGGAACCAGCTACTCCACACCAGGCATGAGTGGCTACAGCA

GTGGCGGAGCGAGTGGCAGTGGTGGGCCTTCCACCAGCGGAACTACCAG

-continued

TGGGCCTGGGCCTGCCCGCCCAGCCCGAGCCCGGCCTAGGAGACCCCGA
GAGGAGACGGAGACAGATCAGTTGGAGGAAGAAAAAGCAGAGCTGGAGT
CGGAGATCGCCGAGCTCCAAAAGGAGAAGGAACGTCTGGAGTTTGTGCT
GGTGGCCCACAAACCGGGCTGCAAGATCCCCTACGAAGAGGGGCCCGGG
CCGGGCCCGCTGGCGGAGGTGAGAGATTTGCCGGGCTCAGCACCGGCTA
AGGAAGATGGCTTCAGCTGGCTGCTGCCGCCCCCGCCACCACCGCCCCT
GCCCTTCCAGACCAGCCAAGACGCACCCCCCAACCTGACGGCTTCTCTC
TTTACACACAGTGAAGTTCAAGTCCTCGGCGACCCCTTCCCCGTTGTTA
ACCCTTCGTACACTTCTTCGTTTGTCCTCACCTGCCCGGAGGTCTCCGC
GTTCGCCGGCGCCCAACGCACCAGCGGCAGTGACCAGCCTTCCGATCCC
CTGAACTCGCCCTCCCTCCTCGCTCTGTGAACTCTTTAGACACACAAAA
CAAACAAACACATGGGGGAGAGAGACTTGGAAGAGGAGGAGGAGGAGGA
GAAGGAGGAGAGAGAGGGGAAGAGACAAAGTGGGTGTGTGGCCTCCCTG
GCTCCTCCGTCTGACCCTCTGCGGCCACTGCGCCACTGCCATCGGACAG
GAGGATTCCTTGTGTTTTGTCCTGCCTCTTGTTTCTGTGCCCCGGCGAG
GCCGGAGAGCTGGTGACTTTGGGGACAGGGGGTGGGAAGGGGATGGACA
CCCCCAGCTGACTGTTGGCTCTCTGACGTCAACCCAAGCTCTGGGGATG
GGTGGGGAGGGGGGCGGGTGACGCCCACCTTCGGGCAGTCCTGTGTGAG
GATTAAGGGACGGGGGTGGGAGGTAGGCTGTGGGGTGGGCTGGAGTCCT
CTCCAGAGAGGCTCAACAAGGAAAAATGCCACTCCCTACCCAATGTCTC
CCACACCCACCCTTTTTTTGGGGTGCCTAGGTTGGTTTCCCCTGCACTC
CCGACCTTAGCTTATTGATCCCACATTTCCATGGTGTGAGATCCTCTTT
ACTCTGGGCAGAAGTGAGCCCCCCCCTTAAAGGGAATTCGATGCCCCCC
TAGAATAATCTCATCCCCCCACCCGACTTCTTTTGAAATGTGAACGTCC
TTCCTTGACTGTCTAGCCACTCCCTCCCAGAAAAACTGGCTCTGATTGG
AATTTCTGGCCTCCTAAGGCTCCCCACCCCGAAATCAGCCCCCAGCCTT
GTTTCTGATGACAGTGTTATCCCAAGACCCTGCCCCCTGCCAGCCGACC
CTCCTGGCCTTCCTCGTTGGGCCGCTCTGATTTCAGGCAGCAGGGGCTG
CTGTGATGCCGTCCTGCTGGAGTGATTTATACTGTGAAATGAGTTGGCC
AGATTGTGGGGTGCAGCTGGGTGGGGCAGCACACCTCTGGGGGGATAAT
GTCCCCACTCCCGAAAGCCTTTCCTCGGTCTCCCTTCCGTCCATCCCCC
TTCTTCCTCCCCTCAACAGTGAGTTAGACTCAAGGGGGTGACAGAACCG
AGAAGGGGGTGACAGTCCTCCATCCACGTGGCCTCTCTCTCTCTCCTCA
GGACCCTCAGCCCTGGCCTTTTTCTTTAAGGTCCCCCGACCAATCCCCA
GCCTAGGACGCCAACTTCTCCCACCCCTTGGCCCCTCACATCCTCTCCA
GGAAGGGAGTGAGGGGCTGTGACATTTTTCCGGAGAAGATTTCAGAGCT
GAGGCTTTGGTACCCCCAAACCCCCAATATTTTTGGACTGGCAGACTCA
AGGGGCTGGAATCTCATGATTCCATGCCCGAGTCCGCCCATCCCTGACC
ATGGTTTTGGCTCTCCCACCCCGCCGTTCCCTGCGCTTCATCTCATGAG
GATTTCTTTATGAGGCAAATTTATATTTTTTAATATCGGGGGGTGGACC

-continued

ACGCCGCCCTCCATCCGTGCTGCATGAAAAACATTCCACGTGCCCCTTG
TCGCGCGTCTCCCATCCTGATCCCAGACCCATTCCTTAGCTATTTATCC
CTTTCCTGGTTTCCGAAAGGCAATTATATCTATTATGTATAAGTAAATA
TATTATATATGGATGTGTGTGTGTGCGTGCGCGTGAGTGTGTGAGCGCT
TCTGCAGCCTCGGCCTAGGTCACGTTGGCCCTCAAAGCGAGCCGTTGAA
TTGGAAACTGCTTCTAGAAACTCTGGCTCAGCCTGTCTCGGGCTGACCC
TTTTCTGATCGTCTCGGCCCCTCTGATTGTTCCCGATGGTCTCTCTCCC
TCTGTCTTTTCTCCTCCGCCTGTGTCCATCTGACCGTTTTCACTTGTCT
CCTTTCTGACTGTCCCTGCCAATGCTCCAGCTGTCGTCTGACTCTGGGT
TCGTTGGGGACATGAGATTTTATTTTTTGTGAGTGAGACTGAGGGATCG
TAGATTTTTACAATCTGTATCTTTGACAATTCTGGGTGCGAGTGTGAGA
GTGTGAGCAGGGCTTGCTCCTGCCAACCACAATTCAATGAATCCCCGAC
CCCCCTACCCCATGCTGTACTTGTGGTTCTCTTTTTGTATTTTGCATCT
GACCCCGGGGGGCTGGGACAGATTGGCAATGGGCCGTCCCCTCTCCCCT
TGGTTCTGCACTGTTGCCAATAAAAAGCTCTTAAAAACGCA, or a nucleic acid sequence that hybridizes to a nucleic acid sequence consisting of SEQ ID NO:210 under stringent hybridization conditions.

In some embodiments, FOS like 1, AP-1 transcription factor subunit (FRA, FRA1, FOSL1) comprises the amino acid sequence:

(SEQ ID NO: 211; NP_001287773.1)

MFRDFGEPGPSSGNGGGYGGPAQPPAAAQAAQQKFHLVPSINTMSGSQE
LQWMVQPHFLGPSSYPRPLTYPQYSPPQPRPGVIRALGPPPGVRRRPCE
QETDKLEDEKSGLQREIEELQKQKERLELVLEAHRPICKIPEGAKEGDT
GSTSGTSSPPAPCRPVPCISLSPGPVLEPEALHTPTLMTTPSLTPFTPS
LVFTYPSTPEPCASAHRKSSSSSGDPSSDPLGSPTLLAL, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:211)

In some embodiments, the nucleic acid sequence encoding FRA comprises the nucleic acid sequence:

(SEQ ID NO: 212; NM_001300844.2)

GAGTCAGAACCCAGCAGCCGTGTACCCCGCAGAGCCGCCAGCCCCGGGC
ATGTTCCGAGACTTCGGGGAACCCGGCCCGAGCTCCGGGAACGGCGGCG
GGTACGGCGGCCCCGCGCAGCCCCCGGCCGCAGCGCAGGCAGCCCAGCA
GAAGTTCCACCTGGTGCCAAGCATCAACACCATGAGTGGCAGTCAGGAG
CTGCAGTGGATGGTACAGCCTCATTTCCTGGGGCCCAGCAGTTACCCCA
GGCCTCTGACCTACCCTCAGTACAGCCCCCCACAACCCCGGCCAGGAGT
CATCCGGGCCCTGGGGCCGCCTCCAGGGGTACGTCGAAGGCCTTGTGAA
CAGGAGACTGACAAACTGGAAGATGAGAAATCTGGGCTGCAGCGAGAGA
TTGAGGAGCTGCAGAAGCAGAAGGAGCGCCTAGAGCTGGTGCTGGAAGC

-continued

```
CCACCGACCCATCTGCAAAATCCCGGAAGGAGCCAAGGAGGGGGACACA
GGCAGTACCAGTGGCACCAGCAGCCCACCAGCCCCCTGCCGCCCTGTAC
CTTGTATCTCCCTTTCCCCAGGGCCTGTGCTTGAACCTGAGGCACTGCA
CACCCCCACACTCATGACCACACCCTCCCTAACTCCTTTCACCCCCAGC
CTGGTCTTCACCTACCCCAGCACTCCTGAGCCTTGTGCCTCAGCTCATC
GCAAGAGTAGCAGCAGCAGCGGAGACCCATCCTCTGACCCCCTTGGCTC
TCCAACCCTCCTCGCTTTGTGAGGCGCCTGAGCCCTACTCCCTGCAGAT
GCCACCCTAGCCAATGTCTCCTCCCCTTCCCCCACCGGTCCAGCTGGCC
TGGACAGTATCCCACATCCAACTCCAGCAACTTCTTCTCCATCCCTCTA
ATGAGACTGACCATATTGTGCTTCACAGTAGAGCCAGCTTGGGGCCACC
AAAGCTGCCCACTGTTTCTCTTGAGCTGGCCTCTCTAGCACAATTTGCA
CTAAATCAGAGACAAAATATTTCCCATTTGTGCCAGAGGAATCCTGGCA
GCCCAGAGACTTTGTAGATCCTTAGAGGTCCTCTGGAGCCCTAACCCCT
TCCAGATCACTGCCACACTCTCCATCACCCTCTTCCTGTGATCCACCCA
ACCCTATCTCCTGACAGAAGGTGCCACTTTACCCACCTAGAACACTAAC
TCACCAGCCCCACTGCCAGCAGCAGCAGGTGATTGGACCAGGCCATTCT
GCCGCCCCCTCCTGAACCGCACAGCTCAGGAGGCGCCCTTGGCTTCTGT
GATGAGCTGATCTGCGGATCTCAGCTTTGAGAAGCCTTCAGCTCCAGGG
AATCCAAGCCTCCACAGCGAGGGCAGCTGCTATTTATTTTCCTAAAGAG
AGTATTTTTATACAAACCTACCAAAATGGAATAAAAGGCTTGAAGCTGT
GGCCTGAGTGCCTCACTGGACCCAGAGGCCAATGGGAGAGTATTTGGAG
CCCTAGGTCCCAGCCTTAGCTCTACAGACTCACTGCATGACCTTGGACA
AATTCTTTGATATTTTTGGACTTTGTCTTATCTGACAAGTGGGGCTACA
TCCGCTCGGCCTCATCTCCGGGACTG,
```

or a nucleic acid sequence that hybridizes to a nucleic acid sequence consisting of SEQ ID NO:212 under stringent hybridization conditions.

In some embodiments, FOS like 2, AP-1 transcription factor subunit (FRA2, FOSL2) comprises the amino acid sequence:

```
                                    (SEQ ID NO: 213; NP_005244.1)
MYQDYPGNFDTSSRGSSGSPAHAESYSSGGGGQQKFRVDMPGSGSAFIP
TINAITTSQDLQWMVQPTVITSMSNPYPRSHPYSPLPGLASVPGHMALP
RPGVIKTIGTTVGRRRRDEQLSPEEEEKRRIRRERNKLAAAKCRNRRRE
LTEKLQAETEELEEEKSGLQKEIAELQKEKEKLEFMLVAHGPVCKISPE
ERRSPPAPGLQPMRSGGGSVGAVVVKQEPLEEDSPSSSSAGLDKAQRSV
IKPISIAGGFYGEEPLHTPIVVTSTPAVTPGTSNLVFTYPSVLEQESPA
SPSESCSKAHRRSSSSGDQSSDSLNSPTLLAL,
```

or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:213) In some embodiments, the nucleic acid sequence encoding FRA2 comprises the nucleic acid sequence:

```
                                    (SEQ ID NO: 214; NM_0052534)
GTAGTGACTCATCTCGGGCAGAGCGCTAGGGCTCCGAGCGAACCAGCGA
GCGAGCGAACGAGCGGCGCTCGGCGGGGACAGAAAGAGGGAGAGAGAGA
GAGAGAGAGAGGGAGAGGCGCGGCCGGGCGAGGCGGGCCCGTCCGGGAG
CGGGCTCCGGGGAAGGGGTGCGGGTCTGGGCGCCGGAGCGGGGAGCGGG
GCCGCGTCCCTCTCAGCGCCAGCTCTACTTGAGCCCCACGAGCCGCTGT
CCCCCTGGCGCGCTCGGGGCCGCGGGACGGGCGCACGCCGCCTTCTCCT
AGTCAAGTATCCGAGCCGCCCCGAAACTCGGGCGGCGAGTCGGCCACGG
GAAGTTTATTCTCCGGCTCCTTTTCTAAAAGGAAGAAACAGAAGTTTCT
CCCAGCGGACAGCTTTTCTTTCCGCCTTTTTGGCCCTGTCTGAAATCGG
GGGTCCCCAGGGCTGGCAGGCCAGGCTCGCTGGGCTCCTAATCTTTTTT
TTAATTTCCAATTTTTGATTGGGCCGTGGGTCCCCGCTGAGCTCCGGCT
GCGCGCGGGGGCGGGAGGGCGCGCGCAGGGGAGGGACCGAGAGACGCGC
CGACTTTTTAGAGGGAGGGATCGGGTGGACAACTGGTCCCGCGGCGCTC
GCAGAGCCGGAAAGAAGTGCTGTAAGGGACGCTCGGGGGACGCTGTTCC
TGAGGTGTCGCCGCCTCCCTGTCCTCGCCCTCCGCGGTGGGGGAGAAAC
CCAGGAGCGAAGCCCAGAGCCCGCGGCGCGGCCGGCGGACGAACGAGCG
CGCAGCAGCCGGTGCGCGGCCGCGGCGAGGGCGGGGGAAGAAAAACACC
CTGTTTCCTCTCCGGCCCCCACCGCGGATCATGTACCAGGATTATCCCG
GGAACTTTGACACCTCGTCCCGGGGCAGCAGCGGCTCTCCTGCGCACGC
CGAGTCCTACTCCAGCGGCGGCGGCGGCCAGCAGAAATTCCGGGTAGAT
ATGCCTGGCTCAGGCAGTGCATTCATCCCCACCATCAACGCCATCACGA
CCAGCCAGGACCTGCAGTGGATGGTGCAGCCCACAGTGATCACCTCCAT
GTCCAACCCATACCCTCGCTCGCACCCCTACAGCCCCCTGCCGGGCCTG
GCCTCTGTCCCTGGACACATGGCCCTCCCAAGACCTGGCGTGATCAAGA
CCATTGGCACCACCGTGGGCCGCAGGAGGAGAGATGAGCAGCTGTCTCC
TGAAGAGGAGGAGAAGCGTCGCATCCGGCGGGAGAGGAACAAGCTGGCT
GCAGCCAAGTGCCGGAACCGACGCCGGGAGCTGACAGAGAAGCTGCAGG
CGGAGACAGAGGAGCTGGAGGAGGAGAAGTCAGGCCTGCAGAAGGAGAT
TGCTGAGCTGCAGAAGGAGAAGGAGAAGCTGGAGTTCATGTTGGTGGCT
CACGGCCCAGTGTGCAAGATTAGCCCCGAGGAGCGCCGATCGCCCCCAG
CCCCTGGGCTGCAGCCCATGCGCAGTGGGGGTGGCTCGGTGGGCGCTGT
AGTGGTGAAACAGGAGCCCCTGGAAGAGGACAGCCCCTCGTCCTCGTCG
GCGGGGCTGGACAAGGCCCAGCGCTCTGTCATCAAGCCCATCAGCATTG
CTGGGGGCTTCTACGGTGAGGAGCCCCTGCACACCCCCATCGTGGTGAC
CTCCACACCTGCTGTCACTCCGGGCACCTCGAACCTCGTCTTCACCTAT
CCTAGCGTCCTGGAGCAGGAGTCACCCGCATCTCCCTCCGAATCCTGCT
CCAAGGCTCACCGCAGAAGCAGTAGCAGCGGGGACCAATCATCAGACTC
CTTGAACTCCCCCACTCTGCTGGCTCTGTAACCCAGTGCACCTCCCTCC
CCAGCTCCGGAGGGGGTCCTCCTCGCTCCTCCTTCCCAGGGACCAGCAC
CTTCAAGCGCTCCAGGGCCGTGAGGGCAAGAGGGGGACCTGCCACCAGG
```

-continued

GAGCTTCCTGGCTCTGGGGGACCCAGGTGGGACTTAGCAGTGAGTATTG

GAAGACTTGGGTTGATCTCTTAGAAGCCATGGGACCTCCTCCCTCATTC

ATCTTGCAAGCAAATCCCATTTCTTGAAAAGCCTTGGAGAACTCGGTTT

GGTAGACTTGGACATCTCTCTGGCTTCTGAAGAGCCTGAAGCTGGCCTG

GACCATTCCTGTCCCTTTGTTACCATACTGTCTCTGGAGTGATGGTGTC

CTTCCCTGCCCCACCACGCATGCTCAGTGCCTTTTGGTTTCACCTTCCC

TCGACTTGACCCTTTCCTCCCCCAGCGTCAGTTTCACTCCCTCTTGGTT

TTTATCAAATTTGCCATGACATTTCATCTGGGTGGTCTGAATATTAAAG

CTCTTCATTTCTGGAGATGGGGCAGCAGGTGGCTCTTCTGCTGGGGCTG

ACTTGTCCAGAAGGGGACAAAGTGCAATACAGAGCCTTCCCTACCCTGA

CGCCTCCCAGTCATCATCTCCAGAACTCCCAGCGGGGCTCCCTGAGCTC

TCAAGGAGATGCTGCCATCACTGGGAGGCTCAGAGGACCCTTCCTGCCC

ACCTTCGGAGACGGCTTCTGGAGGAACGGCTTGGCCAGAAGACAGGGTG

TGAGTGAGACAGTGGGGCACAGGTTGGGTTTGCCAAACGCCTAATTACC

AGGCCAGGAAGCATGCCAACAAAGCCACACGGGTGTCCTAGCCAGCTTC

CCTTCACCTGGTGTCTTGAGTAGGGCGTCTCCTGTAATTACTGCCTTGC

CATTCTGCCCCTGGACCCTTCTCTCCGGACCAGGGAGGCGTCCCTCCCT

AGGAGCCACACATTATACTCCAAGTCCCTGCCGGGCTCCGCCTTTCCCC

CACCCTGGCTCTCAGGGTGACGCCACCCACAGAGATTTAATGAGCGTGG

GCCTGGACCTTCCCCAGATGCTGCCAGGCAGCCCCTCCCCAAGCCTCAA

AGAAGCATTTGCTGAGGATGGAGAGGCAGGGGAGGGAGGCGGGAGGCCG

TCACTGGAGTGGCGTCTGCAGCAGCTGCTGCCCCAGCACCCGCTCAGCC

TGTCCTGGCTGCTCACCTCCCCGCAGGGCACCGGGCCTTTCCTGCCCTC

TGTGGTCATCTGCCACCTGCTGGATCAAGTGCTTTCTCTTTTACACTCC

CCTGTCCCCACCCCAGTGCACTCTTCTGGCCCAGGCAGCAAGCAAGCTG

TGAACAGCTGGCCTGAGCTGTCGCTGTGGCTTGTGGCTCATGCGCCATT

CCTGGTTGTCTGTTGAATCTTTCTGGCTGCTGGAATTGGAGATAGGATG

TTTTGCTTCCCACTGCAGGAGAGCTGCCCCCTTTCACGGGGTTGGGGAA

GGGTCCCCCTGGCCTCCAGCAGGAGCACAGCTCAGCAGGGTCCCTGCTG

CCCACCCCTCTGAGCCTTTTCTCCCCAGGGTATGGCTCCTGCTGAGTTT

CTTGTCCAGCAGGGCCTTGACAGGAATCCAGGGAGTAGCTCCTGGCCAG

AACCAGCCTCTGCGGGGCTTGTGCTCTGCAAAGACTCTGCTGCTGGGGA

TTCAGCTCTAGAGGTCACAGTATCCTCGTTTGAAAGATAATTAGATCCC

CCGTGGAGAAAGCAGTGACACATTCACACAGCTGTTCCCTCGCATGTTA

TTTCATGAACATGCCTGTTTTCGTGCACTAGACACACAGAGTGGAACAG

CCGTATGCTTAAAGTACATGGGCCAGTGGGACTGGAAGTGACCTGTACA

AGTGATGCAGAAAGGAGGGTTTCAAAGAAAAAGGATTTTGTTTAAAATA

CTTTAAAAATGTTATTTCCTGCATCCCTTGGCTGTGATGCCCCTCTCCC

GATTTCCCAGGGGCTCTGGGAGGGACCCTTCTAAGAAGATTGGGCAGTT

GGGTTTCTGGCTTGAGATGAATCCAAGCAGCAGAATGAGCCAGGAGTAG

CAGGAGATGGGCAAAGAAAACTGGGGTGCACTCAGCTCTCACAGGGGTA

-continued

ATCATCTCAAGTGGTATTTGTAGCCAAGTGGGAGCTATTTTCTTTTTTG

TGCATATAGATATTTCTTAAATGAAGCTGCTTTCTTGTCTTTTATTTCT

AAAAGCCCCCTTATACCCCACTTTGTGCAGCAAAGATCCCCGTGCAGGT

CACAGCCTGATTTGTGGCCAGGCTGGACAAATTCCTGAGGCACAACTTG

GCTTCAGTTCAGATTTCAAGCTGTGTTGGTGTTGGGACCAGCAGAAGGC

AAACGTCCAGCCAACACACAGGACTGTAAGAGGACTCTGAGCTACGTGC

CCTGTGAAGACCCCCAGGCTTTGTCATAGGAGGTCGTTCAGCTTCCCCA

AAGTCAGAGGTGATTTGATTTGGGGAAGACTGAATATTCACACCTAAGT

CGTGAGCATATCCTGAGTTTTACTTCCTTATGGCTTGCCCTCCAAGTTC

TCTCTCTCATACACACACACACCCTTGCTCCAGAATCACCAGACACCTC

CATGGCTCCAGCTATGGGAACAGCTGCATTGGGGCTGCCTTTCTGTTTG

GCTTAGGAACTTCTGTGCTTCTTGTGGCTCCACTCGCGAGGCAGCTCGG

AGGTGTGGACTCCGATTGGGCTGCAGGCAGCTCTGGGACGGCACAGGGC

GGGCGCTCTGATCAGCTCGTGTAAAACACACCGTCTTCTTGGCCTCCTG

GCCAGTCTTTCTGCGAATAGTCCTCTCCCTGGCCAGTTGAATGGGGGAA

GCTGCTGGCACAGGAAGGAGAGGCGATCCCGGCTGAGGCTTAGGAAATT

GCTGGAGCCGGCTCCAAGCAGATAATTCACTGGGGAGGTTTTCAGAGTC

AAACATCATTCTGCCTGTGTTGGGGGCCAGGTGTGTCACACAAGCATCT

CAAAGTCAAAAGCCATCTGGGGCTGCTGCTTCTGTTTCTCAGGCTCTGG

GGAAAGGAATCTCCCTCTCCTCTCACTTGATTCCAAGTGTGGTTGAATT

GTCTGGAGCACTGGGACTTTTTTTCTCTTTTCCTTGATGGACCAACAGT

GCAAATGCAATCTCGCCATTTAACTTTCAGGTCGATTTCCTTTCCTGAT

CAGACATCTTTGTGCCCCCTTTAGGAAGGAAAAGAATACACCTACGATG

TGCCAGGCACTGTGTTAGGCGCTTTTATATAGATCCTCGTTAGGATGAG

ACTAAGGGATGAGGACATCTCTTTATAAAAGGCCCCTAAGTAATGGATA

AACAGAAACACTTAGAGGTGAGAAGGTCTGTCTTCAAGATCCAAGGTAA

GATTGCCTTCAGTCTGATGTTTGTTCTCAAGGACTTATCCCCTACAATA

TTCTCCCACTCCATACTTCTCCTTCTACCCCACCATGTGCTCCCGTGCA

CTCCTCAGATGGTCAGAGGGGTAACCCAAGTCCTTAGAGAATTTGGGGA

CCAATAGAATATGTGATGTGTGAATTTTCTTTAAAAAACTTAAGGAGTC

TTTGCTACCTTCTGCTTGTTGAGTTGTTTTGGCATTCATATTAAAAGCC

AGCATCTCACTATTTATTGACAGGTTGGGCTGTGTGTGTGCGCATGTGT

GTATACATTTCCAGGCGTGCCTGTGTCCTGTAGCTTTTAAAAGGAAAC

CCAGTCATCCCACTATGAATCTGGCATCTTCTTATGCTTCTAGTGTTTT

GGCCATACATCAACCAAGGGGTTTAATTTATCCAATGCTTGACGACATG

TTCAGGAGGGGCTGGATCAAATTTTGAGAGGGTTATGGGAAAGGGAGGG

GGAGAAGAAATTGACATTTATTTTATTATTTATTTTAAATGTTTACATC

TTCTTTATGTTGTATCAAGCCTGAATAGAAACTGATAGCATTAAAATAC

TCCGTTCCTCTCTCTCTTCTCGCTTCCTTTTTTTTTTTTTTTTTTAAATT

TAGGATAACACATTTTTGTTTCTAAAGTGATTTGTGATTTGTGCTGTAT

-continued

AAACTGTATAAAAGGTTCTGTTTTTAAAGGTGGATTTTCATTCCTCTGG

GGACAGTGGTCGCCAAGACATCTACATTGTAAGAGAACACAGTGGAAGA

TCCTGTCCTGATTCTCAAAAATTATTTTCTCTGTATGATTAAAAGTTTA

TTCCATTTATTTTAGTTTGTGTTTACTTGATTTTGAGGAAGAAAATATT

TGACTTTGTGTAAAGAGTAGGGTATCAGGGTGTCTTTTCTGCCGTGGGA

GATGTGTATATATATAGTATTTTGGTGTATAGTAGAAAATAAGCTTTGT

GCATCTGTATTTGAGATATGTTAATGACGTGGAGTAAAGTCAGCTGTAA

GACTCTGGAGGCAAACAAGTTGTATATGGTTCATATGGCTCTATGGGGA

ATTTAATTACCTTTCTGGGCACTTTTTTTTTTTTTTTTTTTTTAAGTAA

TGGTGAAATGGTCCCATTGGAGAGTCTCCTAAATAGACCTTCCAGGCAG

AACCGCAAGCTCAAAATCTTTGTATAGTTTTGAAAATTGAGGAGTAGCT

TTGTTTGGAAGCCTTTCTGGTGGTGGTTTTTGTTGTTGTTGTTGTTTTG

TTGTTTTACTATATGTAATACAAGCCTACAGTATTTGCACTAAAGAAAG

CTTGTTAGAAAAAGCTTGCTGCTATGGAAGAAAGAACATATTAAAACTT

CTTTCCCTTGCGATTTTTTTGGGGGAGGGGGGTTAGCATTTCCACTTTC

AGTTGAGTAGCATTTTGTAGAATAAAATGAATTAAGATTGAAGAGCC, or a nucleic acid sequence that hybridizes to a nucleic acid sequence consisting of SEQ ID NO:214 under stringent hybridization conditions.

In some embodiments Jun proto-oncogene, AP-1 transcription factor subunit (JUN, p39, cJUN) comprises the amino acid sequence:

(SEQ ID NO: 215; N NP_002219.1)

MTAKMETTFYDDALNASFLPSESGPYGYSNPKILKQSMTLNLADPVGSLK

PHLRAKNSDLLTSPDVGLLKLASPELERLIIQSSNGHITTTPTPTQFLCP

KNVTDEQEGFAEGFVRALAELHSQNTLPSVTSAAQPVNGAGMVAPAVASV

AGGSGSGGFSASLHSEPPVYANLSNFNPGALSSGGGAPSYGAAGLAFPAQ

PQQQQQPPHHLPQQMPVQHPRLQALKEEPQTVPEMPGETPPLSPIDMESQ

ERIKAERKRMRNRIAASKCRKRKLERIARLEEKVKTLKAQNSELASTANM

LREQVAQLKQKVMNHVNSGCQLMLTQQLQTF, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:215)

In some embodiments, the nucleic acid sequence encoding JUN comprises the nucleic acid sequence:

(SEQ ID NO: 216; NM_002228.4)

GCTCAGAGTTGCACTGAGTGTGGCTGAAGCAGCGAGGCGGGAGTGGAGGTGCGC

GGAGTCAGGCAGACAGACAGACACAGCCAGCCAGCCAGGTCGGCAGTATAGTCC

GAACTGCAAATCTTATTTTCTTTTCACCTTCTCTCTAACTGCCCAGAGCTAGCGCCT

GTGGCTCCCGGGCTGGTGTTTCGGGAGTGTCCAGAGAGCCTGGTCTCCAGCCGC

CCCCGGGAGGAGAGCCCTGCTGCCCAGGCGCTGTTGACAGCGGCGGAAAGCAGC

GGTACCCACGCGCCCGCCGGGGGAAGTCGGCGAGCGGCTGCAGCAGCAAAGAAC

TTTCCCGGCTGGGAGGACCGGAGACAAGTGGCAGAGTCCCGGAGCCAACTTTTGC

AAGCCTTTCCTGCGTCTTAGGCTTCTCCACGGCGGTAAAGACCAGAAGGCGGCGG

AGAGCCACGCAAGAGAAGAAGGACGTGCGCTCAGCTTCGCTCGCACCGGTTGTTG

AACTTGGGCGAGCGCGAGCCGCGGCTGCCGGGCGCCCCCTCCCCCTAGCAGCGG

AGGAGGGGACAAGTCGTCGGAGTCCGGGCGGCCAAGACCCGCCGCCGGCCGGC

CACTGCAGGGTCCGCACTGATCCGCTCCGCGGGGAGAGCCGCTGCTCTGGGAAG

TGAGTTCGCCTGCGGACTCCGAGGAACCGCTGCGCACGAAGAGCGCTCAGTGAGT

GACCGCGACTTTTCAAAGCCGGGTAGCGCGCGCGAGTCGACAAGTAAGAGTGCGG

GAGGCATCTTAATTAACCCTGCGCTCCCTGGAGCGAGCTGGTGAGGAGGGCGCAG

CGGGGACGACAGCCAGCGGGTGCGTGCGCTCTTAGAGAAACTTTCCCTGTCAAAG

GCTCCGGGGGGCGCGGGTGTCCCCCGCTTGCCACAGCCCTGTTGCGGCCCCGAA

ACTTGTGCGCGCAGCCCAAACTAACCTCACGTGAAGTGACGGACTGTTCTATGACT

GCAAAGATGGAAACGACCTTCTATGACGATGCCCTCAACGCCTCGTTCCTCCCGTC

CGAGAGCGGACCTTATGGCTACAGTAACCCCAAGATCCTGAAACAGAGCATGACC

CTGAACCTGGCCGACCCAGTGGGGAGCCTGAAGCCGCACCTCCGCGCCAAGAAC

TCGGACCTCCTCACCTCGCCCGACGTGGGGCTGCTCAAGCTGGCGTCGCCCGAG

CTGGAGCGCCTGATAATCCAGTCCAGCAACGGGCACATCACCACCACGCCGACCC

-continued

CCACCCAGTTCCTGTGCCCCAAGAACGTGACAGATGAGCAGGAGGGCTTCGCCGA

GGGCTTCGTGCGCGCCCTGGCCGAACTGCACAGCCAGAACACGCTGCCCAGCGT

CACGTCGGCGGCGCAGCCGGTCAACGGGGCAGGCATGGTGGCTCCCGCGGTAGC

CTCGGTGGCAGGGGGCAGCGGCAGCGGCGGCTTCAGCGCCAGCCTGCACAGCG

AGCCGCCGGTCTACGCAAACCTCAGCAACTTCAACCCAGGCGCGCTGAGCAGCGG

CGGCGGGGCGCCCTCCTACGGCGCGGCCGGCCTGGCCTTTCCCGCGCAACCCCA

GCAGCAGCAGCAGCCGCCGCACCACCTGCCCCAGCAGATGCCCGTGCAGCACCC

GCGGCTGCAGGCCCTGAAGGAGGAGCCTCAGACAGTGCCCGAGATGCCCGGCGA

GACACCGCCCCTGTCCCCCATCGACATGGAGTCCCAGGAGCGGATCAAGGCGGA

GAGGAAGCGCATGAGGAACCGCATCGCTGCCTCCAAGTGCCGAAAAAGGAAGCTG

GAGAGAATCGCCCGGCTGGAGGAAAAAGTGAAAACCTTGAAAGCTCAGAACTCGG

AGCTGGCGTCCACGGCCAACATGCTCAGGGAACAGGTGGCACAGCTTAAACAGAA

AGTCATGAACCACGTTAACAGTGGGTGCCAACTCATGCTAACGCAGCAGTTGCAAA

CATTTTGAAGAGAGACCGTCGGGGGCTGAGGGGCAACGAAGAAAAAAAATAACAC

AGAGAGACAGACTTGAGAACTTGACAAGTTGCGACGGAGAGAAAAAAGAAGTGTCC

GAGAACTAAAGCCAAGGGTATCCAAGTTGGACTGGGTTGCGTCCTGACGGCGCCC

CCAGTGTGCACGAGTGGGAAGGACTTGGCGCGCCCTCCCTTGGCGTGGAGCCAG

GGAGCGGCCGCCTGCGGGCTGCCCCGCTTTGCGGACGGGCTGTCCCCGCGCGAA

CGGAACGTTGGACTTTTCGTTAACATTGACCAAGAACTGCATGGACCTAACATTCGA

TCTCATTCAGTATTAAAGGGGGGAGGGGGAGGGGGTTACAAACTGCAATAGAGAC

TGTAGATTGCTTCTGTAGTACTCCTTAAGAACACAAAGCGGGGGGAGGGTTGGGGA

GGGGCGGCAGGAGGGAGGTTTGTGAGAGCGAGGCTGAGCCTACAGATGAACTCT

TTCTGGCCTGCCTTCGTTAACTGTGTATGTACATATATATATTTTTTAATTTGATGAA

AGCTGATTACTGTCAATAAACAGCTTCATGCCTTTGTAAGTTATTTCTTGTTTGTTTG

TTTGGGTATCCTGCCCAGTGTTGTTTGTAAATAAGAGATTTGGAGCACTCTGAGTTT

ACCATTTGTAATAAAGTATATAATTTTTTTATGTTTTGTTTCTGAAAATTCCAGAAAGG

ATATTTAAGAAAATACAATAAACTATTGGAAAGTACTCCCCTAACCTCTTTTCTGCAT

CATCTGTAGATACTAGCTATCTAGGTGGAGTTGAAAGAGTTAAGAATGTCGATTAAA

ATCACTCTCAGTGCTTCTTACTATTAAGCAGTAAAAACTGTTCTCTATTAGACTTTAG

AAATAAATGTACCTGATGTACCTGATGCTATGGTCAGGTTATACTCCTCCTCCCCCA

GCTATCTATATGGAATTGCTTACCAAAGGATAGTGCGATGTTTCAGGAGGCTGGAG

GAAGGGGGGTTGCAGTGGAGAGGGACAGCCCACTGAGAAGTCAAACATTTCAAAG

TTTGGATTGTATCAAGTGGCATGTGCTGTGACCATTTATAATGTTAGTAGAAATTTTA

CAATAGGTGCTTATTCTCAAAGCAGGAATTGGTGGCAGATTTTACAAAAGATGTATC

CTTCCAATTTGGAATCTTCTCTTTGACAATTCCTAGATAAAAAGATGGCCTTTGCTTA

TGAATATTTATAACAGCATTCTTGTCACAATAAATGTATTCAAATACCAA, or a nucleic acid sequence that hybridizes to a nucleic acid sequence consisting of SEQ ID NO:216 under stringent hybridization conditions.

In some embodiments, JunB proto-oncogene, AP-1 transcription factor subunit (JUNB) comprises the amino acid sequence:

(SEQ ID NO: 217; NP_0022201)

MCTKMEQPFYHDDSYTATGYGRAPGGLSLHDYKLLKPSLAVNLADPYRSL

KAPGARGPGPEGGGGGSYFSGQGSDTGASLKLASSELERLIVPNSNGVIT

-continued

TTPTPPGQYFYPRGGGSGGGAGGAGGGVTEEQEGFADGFVKALDDLHKMN

HVTPPNVSLGATGGPPAGPGGVYAGPEPPPVYTNLSSYSPASASSGGAGA

AVGTGSSYPTTTISYLPHAPPFAGGHPAQLGLGRGASTFKEEPQTVPEAR

SRDATPPVSPINMEDQERIKVERKRLRNRLAATKCRKRKLERIARLEDKV

KTLKAENAGLSSTAGLLREQVAQLKQKVMTHVSNGCQLLLGVKGHAF, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:217)

In some embodiments, the nucleic acid sequence encoding JUNB comprises the nucleic acid sequence:

(SEQ ID NO: 218; NM_002229.3)

GGGACCTTGAGAGCGGCCAGGCCAGCCTCGGAGCCAGCAGGGAGCTGGGA

GCTGGGGGAAACGACGCCAGGAAAGCTATCGCGCCAGAGAGGGCGACGGG

GGCTCGGGAAGCCTGACAGGGCTTTTGCGCACAGCTGCCGGCTGGCTGCT

ACCCGCCCGCGCCAGCCCCCGAGAACGCGCGACCAGGCACCCAGTCCGGT

CACCGCAGCGGAGAGCTCGCCGCTCGCTGCAGCGAGGCCCGGAGCGGCCC

CGCAGGGACCCTCCCCAGACCGCCTGGGCCGCCCGGATGTGCACTAAAAT

GGAACAGCCCTTCTACCACGACGACTCATACACAGCTACGGGATACGGCC

GGGCCCCTGGTGGCCTCTCTCTACACGACTACAAACTCCTGAAACCGAGC

CTGGCGGTCAACCTGGCCGACCCCTACCGGAGTCTCAAAGCGCCTGGGGC

TCGCGGACCCGGCCCAGAGGGCGGCGGTGGCGGCAGCTACTTTTCTGGTC

AGGGCTCGGACACCGGCGCGTCTCTCAAGCTCGCCTCTTCGGAGCTGGAA

CGCCTGATTGTCCCCAACAGCAACGGCGTGATCACGACGACGCCTACACC

CCCGGGACAGTACTTTTACCCCCGCGGGGGTGGCAGCGGTGGAGGTGCAG

GGGGCGCAGGGGGCGGCGTCACCGAGGAGCAGGAGGGCTTCGCCGACGGC

TTTGTCAAAGCCCTGGACGATCTGCACAAGATGAACCACGTGACACCCCC

CAACGTGTCCCTGGGCGCTACCGGGGGGCCCCCGGCTGGGCCCGGGGGCG

TCTACGCCGGCCCGGAGCCACCTCCCGTTTACACCAACCTCAGCAGCTAC

TCCCCAGCCTCTGCGTCCTCGGGAGGCGCCGGGGCTGCCGTCGGGACCGG

GAGCTCGTACCCGACGACCACCATCAGCTACCTCCCACACGCGCCGCCCT

TCGCCGGTGGCCACCCGGCGCAGCTGGGCTTGGGCCGCGGCGCCTCCACC

TTCAAGGAGGAACCGCAGACCGTGCCGGAGGCGCGCAGCCGGGACGCCAC

GCCGCCGGTGTCCCCCATCAACATGGAAGACCAAGAGCGCATCAAAGTGG

AGCGCAAGCGGCTGCGGAACCGGCTGGCGGCCACCAAGTGCCGGAAGCGG

AAGCTGGAGCGCATCGCGCGCCTGGAGGACAAGGTGAAGACGCTCAAGGC

CGAGAACGCGGGGCTGTCGAGTACCGCCGGCCTCCTCCGGGAGCAGGTGG

CCCAGCTCAAACAGAAGGTCATGACCCACGTCAGCAACGGCTGTCAGCTG

CTGCTTGGGGTCAAGGGACACGCCTTCTGAACGTCCCCTGCCCCTTTACG

GACACCCCCTCGCTTGGACGGCTGGGCACACGCCTCCCACTGGGGTCCAG

GGAGCAGGCGGTGGGCACCCACCCTGGGACCTAGGGGCGCCGCAAACCAC

ACTGGACTCCGGCCCTCCTACCCTGCGCCCAGTCCTTCCACCTCGACGTT

-continued

TACAAGCCCCCCCTTCCACTTTTTTTTGTATGTTTTTTTTCTGCTGGAAA

CAGACTCGATTCATATTGAATATAATATATTTGTGTATTTAACAGGGAGG

GGAAGAGGGGGCGATCGCGGCGGAGCTGGCCCCGCCGCCTGGTACTCAAG

CCCGCGGGGACATTGGGAAGGGGACCCCCGCCCCCTGCCCTCCCCTCTCT

GCACCGTACTGTGGAAAAGAAACACGCACTTAGTCTCTAAAGAGTTTATT

TTAAGACGTGTTTGTGTTTGTGTGTGTTTGTTCTTTTTATTGAATCTATT

TAAGTAAAAAAAAAATTGGTTCTTTATTAA, or a nucleic acid sequence that hybridizes to a nucleic acid sequence consisting of SEQ ID NO:218 under stringent hybridization conditions.

In some embodiments, JunD proto-oncogene, AP-1 transcription factor subunit (JunD) comprises the amino acid sequence:

(SEQ ID NO: 219; NP_001273897.1)

MMKKDALTLSLSEQVAAALKPAAAPPPTPLRADGAPSAAPPDGLLASPDL

GLLKLASPELERLIIQSNGLVTTTPTSSQFLYPKVAASEEQEFAEGFVKA

LEDLHKQNQLGAGAAAAAAAAAAGGPSGTATGSAPPGELAPAAAAPEAPV

YANLSSYAGGAGGAGGAATVAFAAEPVPFPPPPPPGALGPPRLAALKDEP

QTVPDVPSFGESPPLSPIDMDTQERIKAERKRLRNRIAASKCRKRKLERI

SRLEEKVKTLKSQNTELASTASLLREQVAQLKQKVLSHVNSGCQLLPQHQ

VPAY, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:219)

In some embodiments, the nucleic acid sequence encoding JUND comprises the nucleic acid sequence:

(SEQ ID NO: 220; NM_001286968.2)

AGGAGCCGCCGCCAGTGGAGGGCCGGGCGCTGCGGCCGCGGCCGGGGCGG

GCGCAGGGCCGAGCGGACGGGGGGGCGCGGGCCCCCCGGGAGGCCGCGGC

CACTCCCCCCCGGGCCGGCGCGGCGGGGGAGGCGGAGGATGGAAACACCC

TTCTACGGCGATGAGGCGCTGAGCGGCCTGGGCGGCGGCGCCAGTGGCAG

CGGCGGCAGCTTCGCGTCCCCGGGCCGCTTGTTCCCCGGGGCGCCCCCGA

CGGCCGCGGCCGGCAGCATGATGAAGAAGGACGCGCTGACGCTGAGCCTG

AGTGAGCAGGTGGCGGCAGCGCTCAAGCCTGCGGCCGCGCCGCCTCCTAC

CCCCCTGCGCGCCGACGGCGCCCCCAGCGCGGCACCCCCCGACGGCCTGC

TCGCCTCTCCCGACCTGGGGCTGCTGAAGCTGGCCTCCCCCGAGCTCGAG

CGCCTCATCATCCAGTCCAACGGGCTGGTCACCACCACGCCGACGAGCTC

ACAGTTCCTCTACCCCAAGGTGGCGGCCAGCGAGGAGCAGGAGTTCGCCG

AGGGCTTCGTCAAGGCCCTGGAGGATTTACACAAGCAGAACCAGCTCGGC

GCGGGCGCGGCCGCTGCCGCCGCCGCCGCCGCCGCCGGGGGGCCCTCGGG

CACGGCCACGGGCTCCGCGCCCCCCGGCGAGCTGGCCCCGGCGGCGGCCG

CGCCCGAAGCGCCTGTCTACGCGAACCTGAGCAGCTACGCGGGCGGCGCC

-continued

```
GGGGGCGCGGGGGGCGCCGCGACGGTCGCCTTCGCTGCCGAACCTGTGCC
CTTCCCGCCGCCGCCACCCCCAGGCGCGTTGGGGCCGCCGCGCCTGGCTG
CGCTCAAGGACGAGCCACAGACGGTGCCCGACGTGCCGAGCTTCGGCGAG
AGCCCGCCGTTGTCGCCCATCGACATGGACACGCAGGAGCGCATCAAGGC
GGAGCGCAAGCGGCTGCGCAACCGCATCGCCGCCTCCAAGTGCCGCAAGC
GCAAGCTGGAGCGCATCTCGCGCCTGGAAGAGAAAGTGAAGACCCTCAAG
AGTCAGAACACGGAGCTGGCGTCCACGGCGAGCCTGCTGCGCGAGCAGGT
GGCGCAGCTCAAGCAGAAAGTCCTCAGCCACGTCAACAGCGGCTGCCAGC
TGCTGCCCCAGCACCAGGTGCCCGCGTACTGAGTCCGCGCGCGGGGCGCA
TGCGCGGCCACCCTCCCCAAGGGGCGGGCTCGCGGGGGGGTGTCGTGGGC
GCCCCGGACTTGGAGAGGGTGCGGCCCTGGGGACCCCCCCTCCCCGAGTG
TGCCCAGGAACTCAGAGAGGGCGCGGCCCCCGGGGATTCCCCCCCCCCGA
GGGTGCCCAGGACTCGACAAGCTGGACCCCCTGCTCCCGGGGGGGCGAGC
GCATGACCCCCCCGCCCTCGCGCTGCCTCTTTCCCCCGCGCGGCCGCCCC
GTGTTGCACAAACCCGCGCGTCTCGGCTGCCCCTTTGTACACCGCGCCGC
GGAAGGGGGCTCCGAGGGGGCGCAGCCTCAAACCCTGCCTTTCCTTTACT
TTTACTTTTTTTTTTTTTTCTTTGGAAGAGAGAAGAACAGAGTGTTCGAT
TCTGCCCTATTTATGTTTCTACTCGGGAACAAACGTTGGTTGTGTGTGTG
TGTGTTTTCTTGTGTTGGTTTTTTAAAGAAATGGGAAGAAGAAAAAAAAA
TTCTCCGCCCCTTTCCTCGATCTCGCTCCCCCCTTCGGTTCTTTCGACCG
GTCCCCCCTCCCTTTTTTGTTCTGTTTTGTTTTGTTTTGCTACGAGTCCA
CATTCCTGTTTGTAATCCTTGGTTCGCCCGGTTTTCTGTTTTCAGTAAAG
TCTCGTTACGCCAGCTCGGCTCTCCGCCTCCTTCTTCCCCCGCCGGGGCC
TGGCGGGCTGGGCGGGGCCTGGTTCGCTT,
```

or a nucleic acid sequence that hybridizes to a nucleic acid sequence consisting of SEQ ID NO:220 under stringent hybridization conditions.

In some embodiments, ZFP36 ring finger protein (ZFP36, TTP) comprises the amino acid sequence:

```
                              (SEQ ID NO: 221; NP_003398.3)
MDLTAIYESLLSLSPDVPVPSDHGGTESSPGWGSSGPWSLSPSDSSPSGV
TSRLPGRSTSLVEGRSCGWVPPPPGFAPLAPRLGPELSPSPTSPTATSTT
PSRYKTELCRTFSESGRCRYGAKCQFAHGLGELRQANRHPKYKTELCHKF
YLQGRCPYGSRCHFIHNPSEDLAAPGHPPVLRQSISFSGLPSGRRTSPPP
PGLAGPSLSSSSFSPSSSPPPPGDLPLSPSAFSAAPGTPLARRDPTPVCC
PSCRRATPISVWGPLGGLVRTPSVQSLGSDPDEYASSGSSLGGSDSPVFE
AGVFAPPQPVAAPRRLPIFNRISVSE,
```

or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:221)

In some embodiments, the nucleic acid sequence encoding ZFP36 comprises the nucleic acid sequence:

```
                             (SEQ ID NO: 222; NM_003407.5)
AGCCTGACTTCAGCGCTCCCACTCTCGGCCGACACCCCTCATGGCCAACC
GTTACACCATGGATCTGACTGCCATCTACGAGAGCCTCCTGTCGCTGAGC
CCTGACGTGCCCGTGCCATCCGACCATGGAGGGACTGAGTCCAGCCCAGG
CTGGGGCTCCTCGGGACCCTGGAGCCTGAGCCCCTCCGACTCCAGCCCGT
CTGGGGTCACCTCCCGCCTGCCTGGCCGCTCCACCAGCCTAGTGGAGGGC
CGCAGCTGTGGCTGGGTGCCCCCACCCCCTGGCTTCGCACCGCTGGCTCC
CCGCCTGGGCCCTGAGCTGTCACCCTCACCCACTTCGCCCACTGCAACCT
CCACCACCCCCTCGCGCTACAAGACTGAGCTATGTCGGACCTTCTCAGAG
AGTGGGCGCTGCCGCTACGGGGCCAAGTGCCAGTTTGCCCATGGCCTGGG
CGAGCTGCGCCAGGCCAATCGCCACCCCAAATACAAGACGGAACTCTGTC
ACAAGTTCTACCTCCAGGGCCGCTGCCCCTACGGCTCTCGCTGCCACTTC
ATCCACAACCCTAGCGAAGACCTGGCGGCCCCGGGCCACCCTCCTGTGCT
TCGCCAGAGCATCAGCTTCTCCGGCCTGCCCTCTGGCCGCCGGACCTCAC
CACCACCACCAGGCCTGGCCGGCCCTTCCCTGTCCTCCAGCTCCTTCTCG
CCCTCCAGCTCCCCACCACCACCTGGGGACCTTCCACTGTCACCCTCTGC
CTTCTCTGCTGCCCCTGGCACCCCCCTGGCTCGAAGAGACCCCACCCCAG
TCTGTTGCCCCTCCTGCCGAAGGGCCACTCCTATCAGCGTCTGGGGGCCC
TTGGGTGGCCTGGTTCGGACCCCCTCTGTACAGTCCCTGGGATCCGACCC
TGATGAATATGCCAGCAGCGGCAGCAGCCTGGGGGGCTCTGACTCTCCCG
TCTTCGAGGCGGGAGTTTTTGCACCACCCCAGCCCGTGGCAGCCCCCCGG
CGACTCCCCATCTTCAATCGCATCTCTGTTTCTGAGTGACAAAGTGACTG
CCCGGTCAGATCAGCTGGATCTCAGCGGGGAGCCACGTCTCTTGCACTGT
GGTCTCTGCATGGACCCCAGGGCTGTGGGGACTTGGGGGACAGTAATCAA
GTAATCCCCTTTTCCAGAATGCATTAACCCACTCCCCTGACCTCACGCTG
GGGCAGGTCCCCAAGTGTGCAAGCTCAGTATTCATGATGGTGGGGGATGG
AGTGTCTTCCGAGGTTCTTGGGGGAAAAAAAATTGTAGCATATTTAAGGG
AGGCAATGAACCCTCTCCCCCACCTCTTCCCTGCCCAAATCTGTCTCCTA
GAATCTTATGTGCTGTGAATAATAGGCCTTCACTGCCCCTCCAGTTTTTA
TAGACCTGAGGTTCCAGTGTCTCCTGGTAACTGGAACCTCTCCTGAGGGG
GAATCCTGGTGCTCAAATTACCCTCCAAAAGCAAGTAGCCAAAGCCGTTG
CCAAACCCCACCCATAAATCAATGGGCCCTTTATTTATGACGACTTTATT
TATTCTAATATGATTTTATAGTATTTATATATATTGGGTCGTCTGCTTCC
CTTGTATTTTTCTTCCTTTTTTTGTAATATTGAAAACGACGATATAATTA
TTATAAGTAGACTATAATATATTTAGTAATATATATTATTACCTTAAAAG
TCTATTTTTGTGTTTTGGGCATTTTTAAATAAACAATCTGAGTGTAA,
```

or a nucleic acid sequence that hybridizes to a nucleic acid sequence consisting of SEQ ID NO:222 under stringent hybridization conditions.

In some embodiments, EBF transcription factor 1 (EBF1, EBF, COE1, OL1)) comprises the amino acid sequence:

(SEQ ID NO: 223; NP_001277289.1)
MFGIQESIQRSGSSMKEEPLGSGMNAVRTWMQGAGVLDANTAAQSGVGLA
RAHFEKQPPSNLRKSNFFHFVLALYDRQGQPVEIERTAFVGFVEKEKEAN
SEKTNNGIHYRLQLLYSNGIRTEQDFYVRLIDSMTKQAIVYEGQDKNPEM
CRVLLTHEIMCSRCCDKKSCGNRNETPSDPVIIDRFFLKFFLKCNQNCLK
NAGNPRDMRRFQVVVSTTVNVDGHVLAVSDNMFVHNNSKHGRRARRLDPS
EGTPSYLEHAATPCIKAISPSEGVVTTGGATVIIIGDNFFDGLQVIFGTM
LVWSELITPHAIRVQTPPRHIPGVVEVTLSYKSKQFCKGTPGRFIYTALN

-continued

EPTIDYGFQRLQKVIPRHPGDPERLPKEVILKRAADLVEALYGMPHNNQE
IILKRAADIAEALYSVPRNHNQLPALANTSVHAGMMGVNSFSGQLAVNVS
EASQATNQGFTRNSSSVSPHGYVPSTTPQQTNYNSVTTSMNGYGSAAMSN
LGGSPTFLNGSAANSPYAIVPSSPTMASSTSLPSNCSSSSGIFSFSPANM
VSAVKQKSAFAPVVRPQTSPPPTCTSTNGNSLQAISGMIVPPM, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:223)

In some embodiments, the nucleic acid sequence encoding EBF1 comprises the nucleic acid sequence:

(SEQ ID NO: 224; NM_001290360.3)
CCTGCTTCTTCAAGTGAAGGGTACCTCTACAAAAGGAAACTCCAGCCCCTCCTGTC
CTCCACCGGCCTGTGATCATTACAAAAAAAAAAAAAAAAAAAGCAAAAAAAAAAAAAA
AGCACCCAAACCAAAAATCAACCAACCAAACAACCCCCAACAGCCAAGCATACATC
TCTAATTTTATTATTTTGGTCTTTTCGTTGGATTTTCCCTTTCTTCTTTTTTTCGGGTT
ATCGCTCAGTTTTGAGCAGAGGTTTACATTTTTTAAAAATTTGCTTTCCAGCCCGCC
TTGATCTTCTAAGTGCGAGTTCATCGTCTGAGAAAAAAAAAAAATCTCTGGTTGGCGT
TTTTGTTTCTTTTCTTTTCTTTCTTTTCTTTCCTTTTTTTTTTTTTTTAATTTTTTTCAAG
GGGGAGGAGATTTTCCACAAGAAAAGGTTGTTTTCATGTTTGGGATTCAGGAAAGC
ATCCAACGGAGTGGAAGCAGCATGAAGGAAGAGCCGCTGGGCAGCGGCATGAAC
GCGGTGCGGACGTGGATGCAGGGCGCCGGGGTGCTGGACGCCAACACGGCGGC
GCAGAGCGGGGTGGGTCTGGCCCGGGCTCACTTTGAGAAGCAGCCGCCTTCCAAT
CTGCGGAAATCCAACTTCTTCCACTTCGTCCTGGCCCTCTACGACAGACAGGGCCA
GCCCGTGGAGATCGAGAGGACAGCGTTTGTGGGGTTCGTGGAGAAGGAAAAAGAA
GCCAACAGCGAAAAGACCAATAACGGAATTCACTACCGGCTTCAGCTTCTCTACAG
CAATGGGATAAGGACGGAGCAGGATTTCTACGTGCGCCTCATTGACTCCATGACAA
AACAAGCCATAGTGTATGAAGGCCAAGACAAGAACCCAGAAATGTGCCGAGTCTTG
CTCACACATGAGATCATGTGCAGCCGCTGTTGTGACAAGAAAAGCTGTGGCAACCG
AAATGAGACTCCCTCAGATCCAGTGATAATTGACAGGTTCTTCTTGAAATTTTTCCT
CAAATGTAACCAAAATTGCCTAAAGAATGCGGGAAACCCACGTGACATGCGGAGAT
TCCAGGTCGTGGTGTCTACGACAGTCAATGTGGATGGCCATGTCCTGGCAGTCTCT
GATAACATGTTTGTCCATAATAATTCCAAGCATGGGCGGAGGGCTCGGAGGCTTGA
CCCCTCGGAAGGTACGCCCTCTTATCTGGAACATGCAGCTACTCCCTGTATCAAAG
CCATCAGCCCGAGTGAAGGATGGACGACGGGAGGTGCGACTGTGATCATCATAGG
GGACAATTTCTTTGATGGGTTACAGGTCATATTCGGTACCATGCTGGTCTGGAGTG
AGTTGATCACTCCTCATGCCATCCGTGTGCAGACCCCTCCTCGGCACATCCCTGGT
GTTGTGGAAGTCACACTGTCCTACAAATCTAAGCAGTTCTGCAAAGGAACACCAGG
CAGATTCATTTATACAGCGCTCAACGAACCCACCATCGATTATGGTTTCCAGAGGTT
ACAGAAGGTCATTCCTCGGCACCCTGGTGACCCTGAGCGTTTGCCAAAGGAAGTAA
TACTCAAAAGGGCTGCGGATCTGGTAGAAGCACTGTATGGGATGCCACACAACAAC
CAGGAAATCATTCTGAAGAGAGCGGCCGACATTGCCGAGGCCCTGTACAGTGTTC

-continued

CCCGCAACCACAACCAACTCCCGGCCCTTGCTAACACCTCGGTCCACGCAGGGAT

GATGGGCGTGAATTCGTTCAGTGGACAACTGGCCGTGAATGTCTCCGAGGCATCA

CAAGCCACCAATCAGGGTTTCACCCGCAACTCAAGCAGCGTATCACCACACGGGTA

CGTGCCGAGCACCACTCCCCAGCAGACCAACTATAACTCCGTCACCACGAGCATG

AACGGATACGGCTCTGCCGCAATGTCCAATTTGGGCGGCTCCCCCACCTTCCTCAA

CGGCTCAGCTGCCAACTCCCCCTATGCCATAGTGCCATCCAGCCCCACCATGGCC

TCCTCCACAAGCCTCCCCTCCAACTGCAGCAGCTCCTCGGGCATCTTCTCCTTCTC

ACCAGCCAACATGGTCTCAGCCGTGAAACAGAAGAGTGCTTTCGCACCAGTCGTCA

GACCCCAGACCTCCCCACCTCCCACCTGCACCAGCACCAACGGGAACAGCCTGCA

AGCGATATCTGGCATGATTGTTCCTCCTATGTGAAAGAATTGCCTTGAAGAATTGTA

TTAATGAAGAGGTTGGATTCTGCTACAGAGAGTAATCTGATACAAGTCCCAGAGTG

GAACTTTTAACTCAGGCCTTTTTAAGAGGAATCACAATAACTGCAGATTTTTAAACAA

ACAAAATCACCGACCTTGCAAATACTGAAATTGGAAGAGGGATCTGCAAGTGCAGG

GTGTTGGTTAAAGTTGTACCTCCCAAGTATTTGGGGGATATATTTATTCTGTATTGA

CAAAAGCAAATCCACTTTTTCTTTTTCTTTTTTTTTTTTAAGCTTAATTCTGCAATCATT

TGTCTTTTATAAACCGTAAAGCTCTATACAAGGGACACTATAAATAAGACTCCATGTT

TTAATTTATGATGTTTTTAAAGCTGTGTAAAGGAAGAATGAAGTGGTGATATTTACAA

AAAAGTAAAAAAAAAAAAAAAGAAAAAAAGGAAAAAAAAAAAAAGCTTGTATGGGACA

GAATAGGAATGCCAGTTAGATTTTTTAGAAAAACTAAGGGTCGGCTTTTGCGCCTTA

AAGCATATCAAATGGTAGTTAGCTCAGACAGTGCATTTTCAATATCTAACTTAACATG

CCACCCCTTAGCAGTGCAAGCTTATTTATCTCTTTTGTATTGTTGTCTTAAGCAACTG

TGTAAATAAATGCAGCCTGGAAAGTTAAAACGCGATGTAAGTGATCACATTTTTCCC

TCTACTCGAAAATCCAGTGCCTCTAGACAGATTGTTAAAACTGCATATTTAAATCTGA

TCTCATTCTCTCCTTTTACTTAAGTCAGTTTCTTCTGAAGCCGATGGCCTCTCGAGA

GCTTGGTGGCACACATACTGTGTGAGAATCTCCTTTGAGACTTCATGGAACAGGGT

CCAGGCACAGAATTCCACACTCTGCCCTCCAGTTAACAAGCCAAAACCTCACGTAC

GCTCCCCCATTTGCAAGTTTAAAGTTTACTCGTCCTAAATGCAGACTTCATACCTAT

CTTCCAAAAGTTGATAAAAGCAACGTGGCAGGTATTTTCGATTTTCCCATTCCAGAT

ACTGCCTCTATCAGTCGACCCTTACCATTTGTAACATAATAGATTGAAACAACAGGT

TAAGTGCTTTGGAATTAAGAGTTAAAGGGAACCGGGGGTGGAGAAAGGAAAAGAA

GGTTGAGACCTCCAAAACATAGTTTTCTGTTCTATGGGAATTTTTGCTCTCATTATCT

GGGAAGTGTTCTTAAAAATAAGAATTAATAGCAAAGATGCAGCAAAGCTCTGAGGAT

GCATTTGCCTGATATTTTTTTCTTTGCTCTTGTGTTTTTGTATGTAGTTATAAATACTG

TAGATTTTTTTTTGTGATTTTTTGCCAAAGTTGTTGTTCTATTTATACATTTTAATGTC

TTAAGACATTTTTTCAATATCACAAAAAGATTTTACTGCGTATTTTGCAAAGAAAAAA

AGCTCACTACCTTTAGCTTGCACATACTTGCAAAGTTAATTAAAAGGCTTTTTGTTTT

AAAGGGGATTTTGTAAAATATCCATATAAATAATGTATTTATCTTTCGAATTTGTACAT

TGCTTTTCCCTTCTTCCTCTTCCTTCCACCCCCAATTTATTTTATTGTGTATGTTTGCT

ACGTGAAAAGTGCGTATTTGTTTGGTCACCTACACTTGTATTAGCTGTTTCAATGTG

ATTTTTAAACATTTCATTTATAGTTATTTTTAGTATTGTTATAAACCATGCTTCAGTTTT

-continued

TTTAATTTCCACCCAAAAGTCATTGTCTATTTTTGTATTATTTGTAAGTTAAGAAGTTT

TTTCCAATATATGGCAAAAAAAAAAAAAATAGTAGCATATTATTCTTGTAGTATTTAGTT

CAGTAGATTTAAAAAAAAATGTATCCTTTGCTTTGGAAGCTTACAAAACAACCCTAAT

GCTGTTTTACTCTATTAATATGCATGGAATCTCTCCCTTTGGAGTGACGCATTTTGT

GCATTAAATTCTAGGGAGAAACTTCATAGAAATCAATGAACATACTTTCTTTCTTAAG

TCTGCTTGTATATTTCCTCTGTCTTTCACATAAATATAAACCAGCAGATTGGATGCCT

TAACAATGCAAATCATATTCATTTCACTTGTACATTGTAACTGTGCACCAGAACTGTC

AGTCATCACTAACATTCTAAGAAAAAAGAAAAAGAAAAAAAGAAAAAAAAAAAAACAA

AGAAATCGAAAAGCACAAAAGAACTGTTTTGTTACCTTAAGACAATGTAACTTTTTCT

AGTAGAGCAAGAAATCATTTACAACAATGCTGCAACTGTGCATGCCCCCATATGGAT

TTTGCAATGGTTTTCACTAGGCTGTCAAGAGTGCGATTTTTATGGGTTGGGGTGGG

TGGGGGAGGGGAGTTGTGGGAGGGTAGGGGAGGGAGGAAAGCTGTTTTTCATGG

TGAGAAATAATAATGATGACTAATAATAATAAAAAAAACTGGAAAATGTAAGCAAGGT

GGACGCATTGCTTCTCGGTACTCAGAAAGGTTATCTGAATTTGCGTGGTAAGCGCT

GGCCTGAAGATGTACACAAGTTAAAGCCATATTTTATCTGGTGAGCCCCTTAACTGT

TTCTGAAGGAATGAACGGTCAGCCGGGAAGGTGTCCGGCTTAGACCTTGACAACA

GACACTACCCATCTGTCAGCCATGTGCAGTGGTTAGAACTCTTCTTGAAAGTCCAAA

GAGCCTTTAAAATGTGTATAATTTGTGTTTTGTTGCTTCTATTTCTATTGATTAGATGA

AAAGACATTCTGGCCCTCTGATCCTCTTTCTTCTCCACAAAAGTTTTACAAATAAAAG

ATGTTCCCCTAAATACAGAATATGGCTTTAAGAAGAAAATGAAATGAAGAATTAAATT

AAGATTTCAGTGTTGGGGGAAAAAATACAGCTTCTGGATGACTGGATTGCATAACAT

TGCCCTGGCCTCACATTGTACTAGGATGCAGCTTAAATGAAGTCATCTCTAAATCTA

CTAACCTTTCACCTTCTTATCAAAACTTTTTGAATAGACACACACTGTACAGTTCAAT

TGTTAGAGAACCTAACTACTGTAGAGATTGTTAAATTTTTTTTTTTTTTTGCAAAAAT

TCAAGCTGTAAAAACTTTTCAACTTTCACAATATTTAATTAAAGTTACTTCCTGTCTGT

GA, or a nucleic acid sequence that hybridizes to a nucleic acid sequence consisting of SEQ ID NO:224 under stringent hybridization conditions.

In some embodiments, EBF transcription factor 3 (EBF3, COE3, OE2, HADDS) comprises the amino acid sequence:

(SEQ ID NO: 225; NP_001005463.1)

MFGIQENIPRGGTTMKEEPLGSGMNPVRSWMHTAGVVDANTAAQSGVGLA

RAHFEKQPPSNLRKSNFFHFVLALYDRQGQPVEIERTAFVDFVEKEKEPN

NEKTNNGIHYKLQLLYSNGVRTEQDLYVRLIDSMTKQAIVYEGQDKNPEM

CRVLLTHEIMCSRCCDKKSCGNRNETPSDPVIIDRFFLKFFLKCNQNCLK

NAGNPRDMRRFQVVVSTTVNVDGHVLAVSDNMFVHNNSKHGRRARRLDPS

EATPCIKAISPSEGVVTTGGATVIIIGDNFFDGLQVVFGTMLVWSELITP

-continued

HAIRVQTPPRHIPGVVEVTLSYKSKQFCKGAPGRFVYTALNEPTIDYGFQ

RLQKVIPRHPGDPERLPKEVLLKRAADLVEALYGMPHNNQEIILKRAADI

AEALYSVPRNHNQIPTLGNNPAHTGMMGVNSFSSQLAVNVSETSQANDQV

GYSRNTSSVSPRGYVPSSTPQQSNYNTVSTSMNGYGSGAMASLGVPGSPG

FLNGSSANSPYGMKQKSAFAPVVRPQASPPPSCTSANGNGLQAMSGLVVP

PM, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:225)

In some embodiments, the nucleic acid sequence encoding EBF3 comprises the nucleic acid sequence:

(SEQ ID NO: 226; NM_001005463.3)

```
ATTCCTCGGGGAGAGAGGGCTGAGTTTTGTGCGCCTCCGTCCGCTGCGCGCGCC

GCTCCAGGCCCCGCCGCGCCCCGCCTGCGCCCGGGACTGCGCCGCAGCACTCAC

TGCCCCGTTTATTTGTCTTTGGAGCAGGCGGGCCGCGCCAGAAGCGGGCGATCCC

GCAGTGTCCTGCAGCCGCGGACGCCGCCTGGCTAGGATGACACCACGTTGAGCG

CGCCTGCAAACAACAACAACAACAAGCGCCGCCGCGGCCACCGCGTCCTGCTCCT

TCGAAGCGCCGCCGCCGCCGGTGGAGCCGCCTCCGCGCCCCTGGCCGTCCGGA

GCGCCCGGCCGCTGGTGTATGTCGCGCCTGCCCGGGACGGGCTGAAGCCGGCG

GCGGGGCCGGACCGCAGGCGCCGAGCAGGGCGAGGGCGGCCAGGGCAGCCGC

CTGCCGCCAAGCCCCGAGCGCCGCTGCTCGAGGAAACGCTTTCGGCCGGGAGCT

GCGGCCGCCGCCAGCAGTTTTCATGTTTGGGATTCAGGAGAATATTCCGCGCGGG

GGGACGACCATGAAGGAGGAGCCGCTGGGCAGCGGCATGAACCCGGTGCGCTCG

TGGATGCACACGGCGGGCGTGGTGGACGCCAACACGGCCGCCCAGAGCGGCGTG

GGGCTGGCGCGGGCGCACTTCGAGAAGCAGCCGCCTTCCAACCTCCGGAAATCC

AATTTCTTCCACTTCGTGCTGGCGCTCTACGATAGGCAGGGGCAGCCGGTGGAGA

TTGAAAGGACCGCTTTTGTGGACTTTGTGGAGAAAGAGAAAGAGCCAAACAACGAG

AAAACCAACAACGGCATCCACTATAAACTCCAGTTATTGTACAGCAACGGAGTCAG

AACAGAGCAAGATCTGTATGTTCGCCTCATAGATTCAATGACCAAACAGGCCATCG

TCTACGAGGGCCAGGACAAGAACCCGGAGATGTGCCGTGTGCTGCTGACCCACGA

GATCATGTGCAGCCGGTGCTGTGACAAGAAAAGTTGTGGCAATAGAAACGAAACGC

CCTCAGACCCTGTAATCATTGACAGATTCTTTCTAAAGTTTTTCCTCAAGTGCAATCA

GAACTGTTTGAAGAATGCAGGCAACCCTCGAGATATGCGGAGATTCCAGGTTGTTG

TATCGACAACAGTCAACGTGGACGGCCACGTGCTGGCCGTGTCAGACAACATGTTT

GTGCACAACAATTCCAAACACGGGAGGCGGGCCCGCCGCCTAGACCCGTCAGAAG

CCACTCCGTGCATCAAGGCCATCAGTCCCAGTGAAGGCTGGACCACGGGGGGTGC

CACCGTCATCATAATTGGCGACAACTTCTTTGACGGGCTGCAAGTTGTATTCGGAA

CTATGTTGGTGTGGAGCGAGCTGATAACTCCCCATGCCATCCGAGTCCAGACCCC

GCCGAGGCACATTCCTGGCGTCGTCGAAGTGACCCTCTCCTACAAATCCAAGCAGT

TCTGCAAAGGTGCTCCTGGGCGCTTTGTCTACACCGCCCTTAATGAACCAACCATA

GATTACGGCTTTCAGAGGTTGCAGAAAGTGATCCCAAGACATCCGGGTGATCCCGA

AAGGTTACCCAAGGAGGTGTTACTGAAGCGGGCGGCGGACCTGGTGGAAGCCTTA

TACGGAATGCCTCACAACAACCAGGAGATCATCTTGAAGCGAGCGGCGGACATCG

CCGAGGCGCTGTACAGCGTTCCCCGCAATCACAACCAGATCCCCACCCTGGGCAA

CAACCCTGCACACACGGGCATGATGGGCGTCAACTCCTTCAGCAGCCAGCTAGCC

GTCAACGTGTCAGAGACGTCACAAGCCAACGACCAAGTCGGCTACAGTCGCAATA

CAAGCAGCGTGTCCCCGCGAGGCTACGTCCCCAGCAGTACTCCCCAGCAGTCCAA

TTACAACACAGTCAGCACTAGCATGAATGGATATGGAAGTGGCGCCATGGCCAGTC

TAGGGGTCCCTGGCTCGCCTGGATTTCTTAATGGCTCCTCCGCTAACTCTCCCTAC

GGCATGAAACAGAAGAGCGCCTTCGCGCCCGTGGTCCGGCCCCAAGCCTCTCCTC

CTCCTTCCTGCACCAGCGCCAACGGGAATGGACTGCAAGCTATGTCTGGGCTGGT
```

-continued

AGTCCCGCCAATGTGAGGGACTTCTGTTTACCTTCCGCAGCACCCAGCATCAAAGG

ACGGACTTCAGGGGACACGTTTAGTATATTAAGACATGCTGATGGAAACAGTATCTT

CAAAAAAATCAGCAGCAATTGAAATGCTACAAAAGACTTTGTTTAAAGATTTTATTTA

AACTATTAAGAATCAACATGCAAACAGCCTACTTCTTCATGAACAATTCCATTTTATT

GACTGAACTTTTCTCATATTTTCACATTTCTCAGTCCTGAAGAATAAGGAAAACAAAG

CGACGCCTATTTTGTATAAAGTTTCCGACTCCGTCTTGGCCATGTCTAGTAATTGCT

ATGTGTTGGGAGAAACTTTGTGAATGCACCATTTTGATGATCATGAAACGCTGATGA

AAAATGCCTCCAAACATTTTTCTGTACTCATACTTAGATTCACAATGGTTGTGTATCT

CTATAATGTGAAATATTTTTTTGTGGTGATAAAAAGAGGGCCAAGGAGGTATGAGCC

ATCAGACTGGAAAAAAGGATGACTATATGATGAGGAGAAACTGGGGTGGCAGGGA

GGGAGGGAGGGTTTATCACTGCTTAACTTCATCTTCATGAAATGAAACTTTGTAACT

TATTGTAGTTAGAAATTGTAACTTTGATATTGAATTCTCTTGCCTTCAACAAGCACAC

TGACAGAGAAAAAATGCTACTGTCTGTTGGTTCCAATATTCTCCCACTGCTAGAGCT

TCCTGTTAAGCAAGTGTGATCTGCAACATTTTTTCAACTTTTGCTAGCACTGTATACT

ATTGCATTCTTAGGCTACTGTGAGGTCTATGTTTCTTGTACCAGAAATTGTCCTTTTG

ACTTCTAGATCCTTCTTCCCTAATGTGTTTTGTATGTGGTTATAAAATTGTAGACTTT

TGTGATTTTGCCAAAGTTGTAGCTAAATATTTATACACTTGTCTTGAATTTTTTTCAGA

TCCACTTAAAATATTTAGAAAAACAAGTTTTATTCCTTATGTGTCTTATAAGGAATAAA

ATGGTCTTCATTTGACACTTACTTTCCCATGAACACTTGCAGTTGCTAAGGGACTTT

ATTTTGTAACATATCAATTATAAATATTGTATTTATCTTTGAAATTTTGTACATTGCTTT

TCCCACCTTTTCCTTTTTCTTCTTTCTTGTCTGTATTGGTTTTTGATCACGGCCTGGT

GTTGTGATACTGGGAAGAGCATTAGCCAAGAACTTGTCTCTTTGATCTGTTTCGTTA

AGCTGAACCAGTGTCTTTACATTTCATTTGTACTTCAAAAAATATGCTATTGTTTAGA

CTTTCCATCCTTTTTTTTTTTATTTTGAGGAAAAGTCAAATTCATTGTTTATTTTTATAT

TATTTTTAAGTTATCTGAACAAATACTTTTGAAAAAAAAGTTTGTTGTATAGTCAAAAC

AAATCGGTGCCACCCGGCCGTGACAAATCCTAGTAGATTCTGTGCATGTGGAGCG

GCCGCGAAGAGGTGACACCGTTTGGGGCTGTGTCCTTATTTTATTTTATTTTTTTGT

AGAATGTAAAAAGTCATTTTAGATGCCACCCATTGACTTTGCCACATAGCTGAACTG

TGTTTACTGGAAAAAATTCAGAGGCCTAAAGTTTAAAATAAAATTTACTTCTGATGTTT

TAATTAAAATGTTTGCCACATTAACTTTTCTGATGCCTTAAAAGTGAACTTCTTTAAA

GAACCTTTGTGCTATTTTATCACAGGCTTACACTACAATTGTTAATAAATACTTCATT

TGGAGATGTATGGTGTAAAACACACAAACACACACAAAAAAGCACAAGCCCGCTGC

ATGACCCGTCTCTCCTTTCTGGGACTATTTCTGCTGCGTCCTGCACCCTCCTGGGC

CCACCTCCGATTCACAGAGGTTTCAGGGGGACCCAAATCACTGCTGGTTTTCAATT

TTTTTTTAACAATACATTTTTGTGGTCAGTTCCAACAGCACTGTCCGTACTTTTAAAA

CTGGAATGACCTCCTTCAGATATCGTGCCTCTTAGTGCCAAACCCACAGTGAGACC

AAAAGTGTCAGGTGTTTTTTTTTTTTTCTTTCTCCTTTGCACTAAGTGCTTTGCAGAC

ACGGCACAGCAAACATTTTGCAAACTGCAGCAGAAATCGAATTTAAAACAAAAAGGA

GGGACTTTAAAATACCTTCTTGACAAAAATCAACAATGCACAACTTACAAAGTGTTC

ATTCTAGGGACAAAATTAAATAAACAGAATGTCCCCAGGAGTCAGCAGGTCACAGT

-continued

```
CTGGCTTTGTGATGGTTGACAAGGTCTAGCTACATGGGAAAGCCTGAGAAGTCACT
TTGGAACTAAATTGCCTCCATTTTATTTTGTACGAGTAAGGGTTTGATCTACAAAAGA
GCTCACATGGACGCACTGAGAACGCCTGCCAGCTTCCCCATGCCCTCACTTGGTTT
GTGTTTTAGGTTAAGTAGTCAATGCCCACATCACTTCACTGTCTCAAGACTGAGCAC
TTCACTAAATGGTAGATTTTACTGTTAAAGACCCTACAATAAGATTGTTTTATCTGTA
CATTTTTTCAGATATTTAACTGTATAAAAATGTTCATTTTACACAATATTTAATTAAAG
TATTTCTTGTCTGTGAATTTCACTTTTGGTAATTTTCTCTGTTTTTGATTATTAAAATG
ACTAAACACTAA,
```

or a nucleic acid sequence that hybridizes to a nucleic acid sequence consisting of SEQ ID NO:226 under stringent hybridization conditions.

In some embodiments, MAF bZIP transcription factor (MAF, CCA4, AYGRP, c-MAF, CTRCT21) comprises the amino acid sequence:

```
(SEQ ID NO: 227; NP_001026974.1)
MASELAMSNSDLPTSPLAMEYVNDFDLMKFEVKKEPVETDRIISQCGR
LIAGGSLSSTPMSTPCSSVPPSPSFSAPSPGSGSEQKAHLEDYYWMTG
YPQQLNPEALGFSPEDAVEALISNSHQLQGGFDGYARGAQQLAAAAGA
GAGASLGGSGEEMGPAAAVVSAVIAAAAAQSGAGPHYHHHHHHAAGHH
```

-continued

```
HHPTAGAPGAAGSAAASAGGAGGAGGGGPASAGGGGGGGGGGGGGAA
GAGGALHPHHAAGGLHFDDRFSDEQLVTMSVRELNRQLRGVSKEEVIR
LKQKRRTLKNRGYAQSCRFKRVQQRHVLESEKNQLLQQVDHLKQEISR
LVRERDAYKEKYEKLVSSGFRENGSSSDNPSSPEFFM,
```

or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:227)

In some embodiments, the nucleic acid sequence encoding MAF comprises the nucleic acid sequence:

```
(SEQ ID NO: 228; NM_001031804.3)
CTTGCTGGATCAGAGGCTTTAAAATCTTTTTTCATCTTCTAGCTGTAGCTCGGGCTG
CTTGTCGGCTTGGCCTCCCCCTCCCCCCTTTGCTCTCTGCCTCGTCTTTCCCCAGG
ACTTCGCTATTTTGCTTTTTTAAAAAAAGGCAAGAAAGAACTAAACTCCCCCCTCCC
TCTCCTCCAGTCGGGCTGCACCTCTGCCTTGCACTTTGCACAGAGGTAGAGAGCG
CGCGAGGGAGAGAGAGGAAAGAAAAAAAATAATAAAGAGAGCCAAGCAGAAGAGG
AGGCGAGAAGCATGAAGTGTTAACTCCCCCGTGCCAAGGCCCGCGCCGCCCCGGA
CAGACGCCCGCCGCGCCTCCAGCCCCGAGCGGACGCCGCGCGCGCCCTGCCTG
CAGCCCGGGCCGGCGAGGCGAGCCCTTCCTTATGCAAAGCGCGCAGCGGAGCGG
CGAGCGGGGGACGCCGCGCACCGGGCCGGGCTCCTCCAGCTTCGCCGCCGCAG
CCACCACCGCCGCCACCGCAGCTCGCGGAGGATCTTCCCGAGCCTGAAGCCGCC
GGCTCGGCGCGCAAGGAGGCGAGCGAGCAAGGAGGGGCCGGGGCGAGCGAGG
GAGCACATTGGCGTGAGCAGGGGGGAGGGAGGGCGGGCGCGGGGGGCGCGGG
CAGGGCGGGGGGGTGTGTGTGTGAGCGCGCTCGGAGGTTTCGGGCCAGCCACCG
CCGCGCAAGCTAGAAGCGCCCCAGCCCGGCAAGCTGGCTCACCCGCTGGCCACC
CAGCACAGCCCGCTGGCCCCTCTCCTGCAGCCCATCTGGCGGAGCGGCGGCGGC
GGCGGCGGCGGCGGCAGGAGAATGGCATCAGAACTGGCAATGAGCAACTCCGAC
CTGCCCACCAGTCCCCTGGCCATGGAATATGTTAATGACTTCGATCTGATGAAGTTT
GAAGTGAAAAAGGAACCGGTGGAGACCGACCGCATCATCAGCCAGTGCGGCCGTC
TCATCGCCGGGGGCTCGCTGTCCTCCACCCCCATGAGCACGCCGTGCAGCTCGGT
GCCCCCTTCCCCCAGCTTCTCGGCGCCCAGCCCGGGCTCGGGCAGCGAGCAGAA
GGCGCACCTGGAAGACTACTACTGGATGACCGGCTACCCGCAGCAGCTGAACCCC
```

-continued

GAGGCGCTGGGCTTCAGCCCCGAGGACGCGGTCGAGGCGCTCATCAGCAACAGC

CACCAGCTCCAGGGCGGCTTCGATGGCTACGCGCGCGGGGCGCAGCAGCTGGCC

GCGGCGGCCGGGGCCGGTGCCGGCGCCTCCTTGGGCGGCAGCGGCGAGGAGAT

GGGCCCCGCCGCCGCCGTGGTGTCCGCCGTGATCGCCGCGGCCGCCGCGCAGA

GCGGCGCGGGCCCGCACTACCACCACCACCACCACCACGCCGCCGGCCACCACC

ACCACCCGACGGCCGGCGCGCCCGGCGCCGCGGGCAGCGCGGCCGCCTCGGCC

GGTGGCGCTGGGGGCGCGGGCGGCGGTGGCCCGGCCAGCGCTGGGGGCGGCG

GCGGCGGCGGCGGCGGCGGAGGCGGCGGGGGCGCGGCGGGGGCGGGGGGCG

CCCTGCACCCGCACCACGCCGCCGGCGGCCTGCACTTCGACGACCGCTTCTCCG

ACGAGCAGCTGGTGACCATGTCTGTGCGCGAGCTGAACCGGCAGCTGCGCGGGG

TCAGCAAGGAGGAGGTGATCCGGCTGAAGCAGAAGAGGCGGACCCTGAAAAACC

GCGGCTATGCCCAGTCCTGCCGCTTCAAGAGGGTGCAGCAGAGACACGTCCTGGA

GTCGGAGAAGAACCAGCTGCTGCAGCAAGTCGACCACCTCAAGCAGGAGATCTCC

AGGCTGGTGCGCGAGAGGGACGCGTACAAGGAGAAATACGAGAAGTTGGTGAGC

AGCGGCTTCCGAGAAAACGGCTCGAGCAGCGACAACCCGTCCTCTCCCGAGTTTT

TCATGTGAGTCTGACACGCGATTCCAGCTAGCCACCCTGATAAGTGCTCCGCGGG

GGTCCGGCTCGGGTGTGGGCTTGCTAGTTCTAGAGCCATGCTCGCCACCACCTCA

CCACCCCCACCCCCACCGAGTTTGGCCCCCTTGGCCCCCTACACACACACAAACC

CGCACGCACACACCACACACACACACACACACACACACACACCCCACACCCTGCT

CGAGTTTGTGGTGGTGGTGGCTGTTTTAAACTGGGGAGGGAATGGGTGTCTGGCT

CATGGATTGCCAATCTGAAATTCTCCATAACTTGCTAGCTTGTTTTTTTTTTTTTTTA

CACCCCCCCGCCCCACCCCCGGACTTGCACAATGTTCAATGATCTCAGCAGAGTTC

TTCATGTGAAACGTTGATCACCTTTGAAGCCTGCATCATTCACATATTTTTTCTTCTT

CTTCCCCTTCAGTTCATGAACTGGTGTTCATTTTCTGTGTGTGTGTGTGTTTTATTTT

GTTTGGATTTTTTTTTTTAATTTTACTTTTAGAGCTTGCTGTGTTGCCCACCTTTTTTC

CAACCTCCACCCTCACTCCTTCTCAACCCATCTCTTCCGAGATGAAAGAAAAAAAAA

AGCAAAGTTTTTTTTTCTTCTCCTGAGTTCTTCATGTGAGATTGAGCTTGCAAAGGAA

AAAAAAATGTGAAATGTTATAGACTTGCAGCGTGCCGAGTTCCATCGGGTTTTTTTT

TTAGCATTGTTATGCTAAAATAGAGAAAAAAATCCTCATGAACCTTCCACAATCAAG

CCTGCATCAACCTTCTGGGTGTGACTTGTGAGTTTTGGCCTTGTGATGCCAAATCT

GAGAGTTTAGTCTGCCATTAAAAAAACTCATTCTCATCTCATGCATTATTATGCTTGC

TACTTTGTCTTAGCAACAATGAACTATAACTGTTTCAAAGACTTTATGGAAAAGAGAC

ATTATATTAATAAAAAAAAAAAAGCCTGCATGCTGGACATGTATGGTATAATTATTTTT

TCCTTTTTTTTTCCTTTTGGCTTGGAAATGGACGTTCGAAGACTTATAGCATGGCATT

CATACTTTTGTTTTATTGCCTCATGACTTTTTTGAGTTTAGAACAAAACAGTGCAACC

GTAGAGCCTTCTTCCCATGAAATTTTGCATCTGCTCCAAAACTGCTTTGAGTTACTC

AGAACTTCAACCTCCCAATGCACTGAAGGCATTCCTTGTCAAAGATACCAGAATGG

GTTACACATTTAACCTGGCAAACATTGAAGAACTCTTAATGTTTTCTTTTTAATAAGA

ATGACGCCCCACTTTGGGGACTAAAATTGTGCTATTGCCGAGAAGCAGTCTAAAAT

TTATTTTTTAAAAAGAGAAACTGCCCCATTATTTTTGGTTTGTTTTATTTTTATTTTATA

TTTTTTGGCTTTTGGTCATTGTCAAATGTGGAATGCTCTGGGTTTCTAGTATATAATT

-continued

TAATTCTAGTTTTTATAATCTGTTAGCCCAGTTAAAATGTATGCTACAGATAAAGGAA

TGTTATAGATAAATTTGAAAGAGTTAGGTCTGTTTAGCTGTAGATTTTTTAAACGATT

GATGCACTAAATTGTTTACTATTGTGATGTTAAGGGGGGTAGAGTTTGCAAGGGGA

CTGTTTAAAAAAAGTAGCTTATACAGCATGTGCTTGCAACTTAAATATAAGTTGGGTA

TGTGTAGTCTTTGCTATACCACTGACTGTATTGAAAACCAAAGTATTAAGAGGGGAA

ACGCCCCTGTTTATATCTGTAGGGGTATTTTACATTCAAAAATGTATGTTTTTTTTTC

TTTTCAAAATTAAAGTATTTGGGACTGAATTGCACTAAGATATAACCTGCAAGCATAT

AATACAAAAAAAAATTGCAAAACTGTTTAGAACGCTAATAAAATTTATGCAGTTATAA

AAATGGCATTACTGCACAGTTTTAAGATGATGCAGATTTTTTTACAGTTGTATTGTGG

TGCAGAACTGGATTTTCTGTAACTTAAAAAAAAATCCACAGTTTTAAAGGCAATAATC

AGTAAATGTTATTTTCAGGGACTGACATCCTGTCTTTAAAAAGAAATGAAAAGTAAAT

CTTACCACAATAAATATAAAAAAATCTTGTCAGTTACTTTTCTTTTACATATTTTGCTG

TGCAAAATTGTTTTATATCTTGAGTTACTAACTAACCACGCGTGTTGTTCCTATGTGC

TTTTCTTTCATTTTCAATTCTGGTTATATCAAGAAAAGAATAATCTACAATAATAAACG

GCATTTTTTTTTGATTCTGTACTCAGTTTCTTAGTGTACAGTTTAACTGGGCCCAACA

ACCTCGTTAAAAGTGTAAAATGCATCCTTTTCTCCAGTGGAAGGATTCCTGGAGGAA

TAGGGAGACAGTAATTCAGGGTGAAATTATAGGCTGTTTTTTGAAGTGAGGAGGCT

GGCCCCATATACTGATTAGCAATATTTAATATAGATGTAAATTATGACCTCATTTTTT

TCTCCCCAAAGTTTTCAGTTTTCAAATGAGTTGAGCCATAATTGCCCTTGGTAGGAA

AAACAAAACAAAACAGTGGAACTAGGCTTCCTGAGCATGGCCCTACACTTCTGATC

AGGAGCAAAGCCATCCATAGACAGAGGAGCCGGACAAATATGGCGCATCAGAGGT

GGCTTGCGCACATATGCATTGAACGGTAAAGAGAAACAGCGCTTGCCTTTTCACTA

AAGTTGACTATTTTTCCTTCTTCTCTTACACACCGAGATTTTCTTGTTAGCAAGGCCT

GACAAGATTTAACATAAACATGACAAATCATAGTTGTTTGTTTTGTTTTGCTTTTCTCT

TTAACACTGAAGATCATTTGTCTTAAATAGGAAAAAGAAAATCCACTCCTTACTTCCA

TATTTCCAAGTACATATCTGGTTTAAACTATGTTATCAAATCATATTTCACCGTGAAT

ATTCAGTGGAGAACTTCTCTACCTGGATGAGCTAGTAATGATTTCAGATCATGCTAT

CCCCAGAAATAAAAGCAAAAAATAATACCTGTGTGGAATATAGGCTGTGCTTTGATT

TACTGGTATTTACCCCAAAATAGGCTGTGTATGGGGGCTGACTTAAAGATCCCTTG

GAAAGACTCAAAACTACCTTCACTAGTAGGACTCCTAAGCGCTGACCTATTTTTAAA

TGACACAAATTCATGAAACTAATGTTACAAATTCATGCAGTTTGCACTCTTAGTCATC

TTCCCCTAGCACACCAATAGAATGTTAGACAAAGCCAGCACTGTTTTGAAAATACAG

CCAAACACGATGACTTTTGTTTTGTTTTCTGCCGTTCTTAAAAGAAAAAAAGATAATA

TTGCAACTCTGACTGAAAGACTTATTTTTAAGAAAACAGGTTGTGTTTGGTGCTGCT

AAGTTCTGGCCAGTTTATCATCTGGCCTTCCTGCCTATTTTTTACAAAACACGAAGA

CAGTGTGTAACCTCGACATTTTGACCTTCCTTTATGTGCTAGTTTAGACAGGCTCCT

GAATCCACACTTAATTTTGCTTAACAAAAGTCTTAATAGTAAACCTCCCCTCATGAGC

TTGAAGTCAAGTGTTCTTGACTTCAGATATTTCTTTCCTTTTTTTTTTTTTTTCCTCAT

CACAACTAAGAGATACACAAACTCTGAAGAAGCAGAAATGGAGAGAATGCTTTTAAC

AAAAAAGCATCTGATGAAAGATTTTAGGCAAACATTCTCAAAATAAGAGTGATATTCT

-continued

GGATGTAGTTATTGCAGTTATCTCATGACAAATGAGGCCTGGATTGGAAGGAAAATA

TAGTTGTGTAGAATTAAGCATTTTGATAGGAATCTACAAGGTAGTTGAATATAATAAG

CAGGTTTGGGCCCCCAAACTTTAGAAAATCAAATGCAAAGGTGCTGGCAAAAATGA

GGTTTGAGTGGCTGGCTGTAAGAGAAGGTTAACTCCTAGTAAAAGGCATTTTTAGA

AATAACAATTACTGAAAACTTTGAAGTATAGTGGGAGTAGCAAACAAATACATGTTTT

TTTTTTCTTACAAAGAACTCCTAAATCCTGAGTAAGTGCCATTCATTACAATAAGTCT

CTAAATTTAAAAAAAAAAAAATCATATGAGGAAATCTAGCTTTCCCCTTTACGCTGCG

TTTGATCTTTGTCTAAATAGTGTTAAAATTCCTTTCATTCCAATTACAGAACTGAGCC

CACTCGCAAGTTGGAGCCATCAGTGGGATACGCCACATTTTGGAAGCCCCAGCATC

GTGTACTTACCAGTGTGTTCACAAAATGAAATTTGTGTGAGAGCTGTACATTAAAAA

AAATCATCATTATTATTATTATTTGCAGTCATGGAGAACCACCTACCCCTGACTTCTG

TTTAGTCTCCTTTTTAAATAAAAATTACTGTGTTAGAGAAGAAGGCTATTAAATGTAG

TAGTTAACTATGCCTCTTGTCTGGGGGTTTCATAGAGACCGGTAGGAAAGCGCACT

CCTGCTTTTCGATTTATGGTGTGTGCAAGTAAACAGGTGCATTGCTTTCAACCTGCC

ATACTAGTTTTAAAAATTCACTGAAATTACAAAGATACATATATATGCATATATATAAT

GGAAAGTTTCCCGGAATGCAACAATTAGCATTTTAAAATCATATATAGGCATGCACA

TTCTAAATAGTACTTTTTCATGCTTCATTGTTTCTCTGGCAGATAATTTTACTAAGAA

GAAAAATAGATATTCGACTCCCCTTCCCTAAACAAATCCACGGGCAGAGGCTCCAG

CGGAGCCGAGCCCCCTGGTTTTCTCGTAGGCCCTAGACGGTGTTGCATTTATCAGT

GATGTCAAACGTGCTCATTTGTCAGACATAGCTGTAAATGAAAACAATGTGTGGCAA

AATACAAAGTTAGTTAAATACA, or a nucleic acid sequence that hybridizes to a nucleic acid sequence consisting of SEQ ID NO:228 under stringent hybridization conditions.

In some embodiments, nuclear protein 1 (NUPR1, P8, COM1) comprises the amino acid sequence:

(SEQ ID NO: 229; NP_001035948.1)

MATFPPATSAPQQPPGPEDEDSSLDESDLYSLAHSYLGPLIMPMPTSP

LTPALVTGGGGRKGRTKREAAANTNRPSPGGHERKLVTKLQNSERKKR

GARR, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:229)

In some embodiments, the nucleic acid sequence encoding NUPR1 comprises the nucleic acid sequence:

(SEQ ID NO: 230; NM_001042483.2)

GCCAGGAAAGCAGAGACAGACAAAGCGTTAGGAGAAGAAGAGAGGCAG

GGAAGACAAGCCAGGCACGATGGCCACCTTCCCACCAGCAACCAGCGC

CCCCCAGCAGCCCCCAGGCCCGGAGGACGAGGACTCCAGCCTGGATGA

ATCTGACCTCTATAGCCTGGCCCATTCCTACCTCGGGCCTCTCATCAT

GCCTATGCCCACTTCACCTCTGACTCCTGCCTTGGTTACAGGAGGTGG

-continued

AGGCCGGAAAGGTCGCACCAAGAGAGAAGCTGCTGCCAACACCAACCG

CCCCAGCCCTGGCGGGCACGAGAGGAAACTGGTGACCAAGCTGCAGAA

TTCAGAGAGGAAGAAGCGAGGGGCACGGCGCTGAGACAGAGCTGGAGA

TGAGGCCAGACCATGGACACTACACCCAGCAATAGAGACGGGACTGCG

GAGGAAGGAGGACCCAGGACAGGATCCAGGCCGGCTTGCCACACCCCC

CACCCCTAGGACTTATTCCCGCTGACTGAGTCTCTGAGGGGCTACCAG

GAAAGCGCCTCCAACCCTAGCAAAAGTGCAAGATGGGGAGTGAGAGGC

TGGGAATGGAGGGGCAGAGCCAGGAAGATCCCCCAGAAAAGAAAGCTA

CAGAAGAAACTGGGGCTCCTCCAGGGTGGCAGCAACAATAAATAGACA

CGCACGGCAGCCACAGCTTGGGTGTGTGTTCATCCTTGTTCTTTGTGT

GTTTTTGTTCGGGCATGTGTGTGCTTGCCTGTGCCTGCACATTCATGA

GCCTGAGAGAGCATCTTTGATGTGTATTTGTGTTTGGTGTATGTATCT

GGGGCAGGGAGTGTTCCTGCTCTTGCAGGGTCTACGCTGTGAATGCAG

CTTTTGGTTTGTTTGCTTTTGCTTGCATATATTTTAGTGCATACATTT

CTGTGGGCTCCTACGTAGTGGAAAGGAATTTCTTCTGCTTTTTTGCGA

TACTGCCCATGAAACACGGCCCTCCCCAGCACCTGTTTTTGTTGATTG

TGTCCTGTTCATAGACGGGAACGCTACTTATGAGTGCCATCTAAAAGT

CAGAGAAAACTGAGATTTAAAATATTAAAAGCCAGGGCCGGGGGCAGT

-continued

GGCTCACGCCTGTAATCCCAGCACTTTGGGAGGCCGAGGTGGGTGGAT
CACAAAGTCAGGAGTTCAAGACCAGCCTGACCAACATGGTGAAACCCC
ATCTCCACTAAAAATACCAAAAATTAGCCAAGCATGGTGGCAGGTGCC
TGTAATCCCAGCTGCTCAGGAGGCTGAGGCAGTAGAATCGCTTGAACC
CAGGAGGTAGAGGTTGCAGTGAGCCGACATCGTGCCATTGCACTCCAG
CCTGGGTGACAGAGGGAGACTCTGTCTCAAAACAAACAAACAAACAAA
AACTAAAGTCTGGGAGCAGTGGCTCATGCCTGTAATCACAGCAGTTTA
GGAGGCCGAAGTGGGAGGATTACTTGAGCCTAGGAGTTTGAGACCAGC
CTGAGCATCATAGTAAGACCCCATCTCTACAATTTTTTTTTTGAGACA
GAGTCTCACTCTGTTGCTCAGGTTAGAGTGCAGTGGCACCATCTTGGC
TCACTGCAACCTCTGCCTCCCGGGTTCAAGCAATTCTCGTGCCTACGC
CCCCTGAGTAGCTGGGATTACAGGTGAGCACCACCACGCCTGGCTAAT
TTTTGTTTTTTTGTTTTTTTGATACAGAGTCTCACTCTGTTGCTCAGG
CTGGAGTGCAGTGGCATGATCGCAGCTCACTGCAACCTCCGCCTCCTG
GGTTCAAGCTATTCTCCTGCTTCAGCCTCCTGAGTAGCTGGGACTACA
GGCACCTGCCACCATGCCTGGCTAATTTTTGTATTTTTAGTAGAAACA
GAGTTTCACCATGTTGGCCAGGATGGTCTCAATCTCTTGACCTCATGA
TCCACCCACCTTGGCCTCCCAAAGTGCTGGGATTACAGGCGTCAGCCA
CCACGCCTGGCCAATTTTTGTATTTTTAGTAGAGATGGGGTTTCATCA
TGTTGGCCAGGCTGGTCTCAAACTCCTGGCCTCAAATGATCTGCCCAC
CTCAGCCTTCCAGCCTTTGGGAGGCCAAGGAGGGAGGATCGCTTGAGG
CCAGGAGTTCGAGACCAGCCTAGGCAACATACCAAGGCCCTGTCTCTA
CAAAAATTTAAAAATTAGCAAAGCATGGTGGCTCATGCCTGTAGTCCT
AGTTGCTCAGAGGCTGAAGTTGGAGGATCCCTTGAACCCAGTTGGAGG
CTACAGTAAGCCATGATGGTGCCACTGCACTGCAGCCTGAGCAATAGA
GTGAAACCATGTATTGAAAAAGAAAGAAAGAAAGAAAGAGAAAAAGAA
GGAAGGAAGGAAAAGAAAGGAAGGAAGAAAGAAAAGAAAGAGAGAAAG
GAGAGAAAAAGAAGAAAGAGAGAGAAAGAGAAGAAAGAAAGAAAGAAA
GAAAGAAAGAAAGAAAGAAAGAAAGAAAGAAAGGAAGGAAGGAAAGAA
AGAAAGAAAGAAGGAAAGAAAGAAAGAAAGAAAGAAAGAAAGAAAGAA
AGAAAAGAGCGAGCCCCGGCACAGTGGCTCACACCTGTAATCCCAGCA
CTTTGGGAGGCCAAGGCAGGCGGATCACCTGAGGTCAGTAGTTCGAGT
TCGAGGCAGAAGTTGTGGTGAGCCAAGATCACGCCATTGCACTCCAGC
CTGGGCAACAAGAGCAAAACTCCATCTCAAAAAAAGAAAAAGAGAGAG
AAAGAAAGAGAGAAGGAGGGAAAGAAAGAGGAAGGAAAGGAGGGAGGG
AAGGAGGGAAGGAGGAAAGGAGGGAAGGAAATATTAAGGGATTTGCCC
TAGCTCACTCAGGGCTCATATTCAGGGATCTTATTGTCTTCAGATATG
AGGTGGGTCCCCAGGCCAAGGGGGCTGTGGGACAGGGTTCTGGGAAGT
GAGATGGGGGAGGGAGATTCTTATTCAGTGCTATGTCTCAGGACCAGA
GTTGAAGAAAAATATGGGGCAAACAGGAAGTGTGGTTGGAGCTGAGAT
TATTTGTTGATTGAGATACAGGTTTGGGTTGCTATTATGAAGAATCAA

-continued

AACAGGATACAAAGTTACTCCTCTCTTACTTAGCCCCAAGTCCTCCTG
GGTTCAAATGGCAGCTCCATTGTGTTGAGGATTCCAGCTATTTTTACT
CACTGTTCTGCCACACCCAAAACATGGCTTCCACTTTGAGGCCCAAAA
TAGCTACTCCAATACCTGCCATCACGTTTGCATCTCAGCCTGTGGAAA
GAGTGTGGAAGAGACAGAGGAGGCCACACCTCTTCAATTTTAGGGCAT
AATCTAAAAGTAGAACACATCACATCTGCTCCGAATGTGGCTACATGG
CCACACCCAACTACGAGAGAGGTTGGGAAATGTAGCATTGAGCTGCTT
AGCCACGTGGTAGCCAAAACTTGGGCAACAGCAGGGTTTTATGATGAA
AGGGAACCAGAGAGAGTGAATACACGAAGAAGCTAGCAAGAAACATTG
CCCACATGCAGACTCAACAGATGTCGGGGGAGAAAACTCTGAGATTGG
GCCCCGGGCAGAGCCTGTTTCCTTTTCCCCTGTCCCTTTCACATAAGC
CCCACACTGCAGAACTTGGAGTCAGTGGTTCATGGGGACCCAAGGACA
TCCACAGAAGACCGAAGTACCTGATAGAGCAGGAACAGATGCACGTCA
GACTACGACCAGCTTGAACCCTTGGGGACCTGTATCCATCCCCTTCCC
TTGAGTCCAGCCTAATCACAGCCACAGAATGAATCCATGACCCGGAAG
GACATTTAAGGACCTCTGGCCCAACTCTCCCCACGCAACAGTGGGATT
GCCTCTGCTTGTTTGAATACCACTATGGAGGGGGAACTTGCTACATTT
AAAGGTTGCTGAATTTTTTTTGTTTTGTTTTGGGAGATGGAGTCTCTCT
CTGTCGCCCAGGCTGGAGTGCAGTGGTGTGATCTCGACCCACTGCAAC
CTCCGCTTCCTGGGTTCAAGCGATTTTCATGCCTCAGCCTCCCTAGTA
GCTGGGACTACAGGTGTGGGCCACCACACCTGGCTAATTTTTGTATTT
TTAGTAGAGACGGGGTTTCACCATGTTGCCCAGGCTGGTCTCAAACTC
CCGACCTCAGGTGATCTGCCTGCCTTGGCCTCCCAAAGTGTTGGGATT
ACAGGCTTGAGCCACACCACCCGGCAAAGGTTGCCTAATTCTATCTCA
GGGCAAGTCTGTTCATGTGGGCTGAAATCTGTCTCTCATACCTGCCCT
TAAATAAGCTTCTGTTTTTCTGGTCCTTTCTGTCTGAGATGACTTTAA
TTCCTCCCCCGACCCCATCTCATGAGGCTCAGCTTAGATGTTTCCTTC
TCTTCCTCCCTGATGGCTGCGTGCAGAAGCTCATACCTGCAATCCCAG
CACTTTGGGAGGCCGAGGTGGGAGGATTGCTTGGGCCCAGGAGTTCTA
GGCCAGCCTAGCAACACAGCAAGACCCTCTCTCTACAAAAAATTAAAA
ATTAGCCAGGTGTGGTGGCTTGTGCCTGTGGGCCCACCTACTCAGGAG
GCTGAGGTGAGAGGATCTCTTGAGTCTGGGAGGTGGAGGCTGCAGTGA
GCCATGATCTCACTCCAGCCTGGGCGTCAGAGTGAGACCTGTCTCAAA
AAAACAAAAACCAAAGTTTTCCTTAACTTGCAATCCTCCACCCATCTC
CTGACCTCCACCCCAGGCCGACCCTCCTCTGGGATCACACGGAAGCCT
GGGCCCAGAATCTTACAGTCTACCTTGGAAATCCTTCAGATTTTGCCT
CCAACTCCTCTTTCCATACAAGTTACATATTAACTCAATCAATGCTTA
TTGGATGCCTTCTGAGTTACCAGGATGCTGCTGGAGGCCTGTGCTGCT
GAGAGGGACAAATAGAATCCTGATATGACTGGAACCAGGAATAGGGCC
ACCATCAGCTCTAGAACCCAGGGAGCAAATGGCAGGAGCAACACCAGG

-continued

CAGTCGGCCCTCAGCCCAGCACAGACCTGGTGTGTTGGCTTCAGAAAA

TCCTGGAAACATCTCTGCTGTGTTTGGAGCTCCTATTCTGTGAGAAGT

GTTTTATAGGCTTTGCTCCATTTAATCCTTACGATAACCCAATAGGAC

ATACTATTAATGATCCCCTTTTTTTCAGACCGGAAAACTGAGGTTCGG

AGACATTAAGTAATTTGCCTAAAGTCACACAGCCACATCCTGTAGGAC

TTGGAATTATGAACTCAGGTCTATCTGAATTTTAAAGCCTGGATTTTT

CCCCCTTTGCTACATGCCTGGGAAGAACCATGTATTGACAATGAAGAA

TCCTAAACTCTCGTTAA, or a nucleic acid sequence that hybridizes to a nucleic acid sequence consisting of SEQ ID NO:230 under stringent hybridization conditions.

In some embodiments, twist family bHLH transcription factor 1 (TWIST1, CRS, CSP, SC3, ACS3, CRS1, BPES2/3, SWCOS, TWIST) comprises the amino acid sequence:

(SEQ ID NO: 231; NP_000465.1)

MMQDVSSSPVSPADDSLSNSEEEPDRQQPPSGKRGGRKRRSSRRSAGG

GAGPGGAAGGGVGGGDEPGSPAQGKRGKKSAGCGGGGGAGGGGGSSSG

GGSPQSYEELQTQRVMANVRERQRTQSLNEAFAALRKIIPTLPSDKLS

KIQTLKLAARYIDFLYQVLQSDELDSKMASCSYVAHERLSYAFSVWRM

EGAWSMSASH, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:231)

In some embodiments, the nucleic acid sequence encoding TWIST1 comprises the nucleic acid sequence:

(SEQ ID NO: 232; NM_000474.4)

AACTCCCAGACACCTCGCGGGCTCTGCAGCACCGGCACCGTTTCCAGG

AGGCCTGGCGGGGTGTGCGTCCAGCCGTTGGGCGCTTTCTTTTTGGAC

CTCGGGGCCATCCACACCGTCCCCTCCCCCTCCCGCCTCCCTCCCCGC

CTCCCCCGCGCGCCCTCCCCGCGGAGGTCCCTCCCGTCCGTCCTCCTG

CTCTCTCCTCCGCGGGCCGCATCGCCCGGGCCGGCGCCGCGCGCGGGG

GAAGCTGGCGGGCTGAGGCGCCCCGCTCTTCTCCTCTGCCCCGGGCCC

GCGAGGCCACGCGTCGCCGCTCGAGAGATGATGCAGGACGTGTCCAGC

TCGCCAGTCTCGCCGGCCGACGACAGCCTGAGCAACAGCGAGGAAGAG

CCAGACCGGCAGCAGCCGCCGAGCGGCAAGCGCGGGGGACGCAAGCGG

CGCAGCAGCAGGCGCAGCGCGGGCGGCGGCGCGGGGCCCGGCGGAGCC

GCGGGTGGGGGCGTCGGAGGCGGCGACGAGCCGGGCAGCCCGGCCCAG

GGCAAGCGCGGCAAGAAGTCTGCGGGCTGTGGGGCGGCGGCGGCGCGG

GCGGCGGCGGCGGCAGCAGCAGCGGCGGCGGGAGTCCGCAGTCTTACG

AGGAGCTGCAGACGCAGCGGGTCATGGCCAACGTGCGGGAGCGCCAGC

GCACCCAGTCGCTGAACGAGGCGTTCGCCGCGCTGCGGAAGATCATCC

CCACGCTGCCCTCGGACAAGCTGAGCAAGATTCAGACCCTCAAGCTGG

CGGCCAGGTACATCGACTTCCTCTACCAGGTCCTCCAGAGCGACGAGC

TGGACTCCAAGATGGCAAGCTGCAGCTATGTGGCTCACGAGCGGCTCA

GCTACGCCTTCTCGGTCTGGAGGATGGAGGGGGCCTGGTCCATGTCCG

CGTCCCACTAGCAGGCGGAGCCCCCCACCCCCTCAGCAGGGCCGGAGA

CCTAGATGTCATTGTTTCCAGAGAAGGAGAAAATGGACAGTCTAGAGA

CTCTGGAGCTGGATAACTAAAAATAAAAATATATGCCAAAGATTTTCT

TGGAAATTAGAAGAGCAAAATCCAAATTCAAAGAAACAGGGCGTGGGG

CGCACTTTTAAAAGAGAAAGCGAGACAGGCCCGTGGACAGTGATTCCC

AGACGGGCAGCGGCACCATCCTCACACCTCTGCATTCTGATAGAAGTC

TGAACAGTTGTTTGTGTTTTTTTTTTTTTTTTTTTTTGACGAAGAATGT

TTTTATTTTTATTTTTTTCATGCATGCATTCTCAAGAGGTCGTGCCAA

TCAGCCACTGAAAGGAAAGGCATCACTATGGACTTTCTCTATTTTAAA

ATGGTAACAATCAGAGGAACTATAAGAACACCTTTAGAAATAAAAATA

CTGGGATCAAACTGGCCTGCAAAACCATAGTCAGTTAATTCTTTTTTT

CATCCTTCCTCTGAGGGGAAAAACAAAAAAAAACTTAAAATACAAAAA

ACAACATTCTATTTATTTATTGAGGACCCATGGTAAAATGCAAATAGA

TCCGGTGTCTAAATGCATTCATATTTTTATGATTGTTTTGTAAATATC

TTTGTATATTTTTCTGCAATAAATAAATATAAAAAATTTAGAGAA, or a nucleic acid sequence that hybridizes to a nucleic acid sequence consisting of SEQ ID NO:232 under stringent hybridization conditions In some embodiments, twist family bHLH transcription factor 2 (TWIST2, AMS, FFDD3, BBRSAY, DERMO1, SETLSS) comprises the amino acid sequence:

(SEQ ID NO: 233; NP_001258822.1)

MEEGSSSPVSPVDSLGTSEEELERQPKRFGRKRRYSKKSSEDGSPTPG

KRGKKGSPSAQSFEELQSQRILANVRERQRTQSLNEAFAALRKIIPTL

PSDKLSKIQTLKLAARYIDFLYQVLQSDEMDNKMTSCSYVAHERLSYA

FSVWRMEGAWSMSASH, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:233)

In some embodiments, the nucleic acid sequence encoding Fos comprises the nucleic acid sequence:

(SEQ ID NO: 234; NM_001271893.4)

GCACAAGCCGGCCTTGAAATCAGAGCCTTTCCAGCAACTCCGAGAGCG

TGTGCTCGGCGACCGCGGGCTTGGCCAGCGGCGCGCGCTCGGCGCCCC

GGCGCCCCCAGCCCCACGCGCGCCGGGCGGGCGCCATGGAGGAGGGCT

CCAGCTCGCCCGTGTCCCCCGTGGACAGCCTGGGCACCAGCGAGGAGG

AGCTCGAGAGGCAGCCCAAGCGCTTCGGCCGGAAGCGGCGCTACAGCA

AGAAGTCGAGCGAAGATGGCAGCCCGACCCCGGGCAAGCGCGGCAAGA

AGGGCAGCCCCAGCGCGCAGTCCTTCGAGGAGCTGCAGAGCCAGCGCA

-continued

TCCTGGCCAACGTGCGCGAGCGCCAGCGCACCCAGTCGCTCAACGAGG
CCTTCGCGGCGCTGCGCAAGATCATCCCCACGCTGCCCTCTGACAAGC
TGAGCAAGATCCAGACGCTCAAGCTGGCCGCCAGGTACATAGACTTCC
TCTACCAGGTCCTGCAGAGCGACGAGATGGACAATAAGATGACCAGCT
GCAGCTACGTGGCCCACGAGCGCCTCAGCTACGCCTTCTCCGTGTGGC
GCATGGAGGGCGCGTGGTCCATGTCCGCCTCCCACTAGCGCCGCGCCA
CCCACCTCCGGACCGGCGCGCCAGGGCTGTCCGTCGCGTCGGCGGCGC
AAGTGGAATTGGGATGCATTCGAGTCTGTAACTTCTGAAACCTGAACA
ACCTCAGGAGGCCCCCACCTCTGCCCTCCACCAGCGTCGAGAGAAGGG
ACAGCAGTGACATCGGACAGAAGACCCGGGCTCCCGTCCTCCCCCAGG
ACGGTCCCCACATAGGAAGGGCACTCCCAGCCCTCTTGCTGGTGACAT
TGTCATGGTCATCTTGTTTCTGTTTGGATTTTTCTTCTGGGTCTTATG
TTTGGGGGGAGGTTTATTCTTTCTGAAAATGTCTAGATTCAGGAACAC
ATTTATGAGGATTTGGATTTTGAATTTGTATTTCCCTCTAAGTGCCTT
TTTTAATGTCTATTTTTTTAATAAAACAGAAATGCATTCTTGTACAAT
TCTGTTGAAACTGGACCAAGGCTCTCAGAAGAGGACCCCCGAGTTCCT
TCCCCTCCCCCGAGCCTCTGCATGATTGTTTCAAGTCAGCCTGGAATT
CTTACTTTCACGCCGCTATTCTTTTCCTTTCTCCGTGATTGCTTGGCT
AGCCATTTAAAAAAAAATATTCTCTGTTCAGTGTATATGTTGCTTGTT
TGTTTTATTTATTGAGATATTTTTACAAGCTAAGTGACTGCAGTGTGG
CTGTGTATCCTGCTCCCCACCCAGGAAAAATAAAGACGTCCGCGCA, or a nucleic acid sequence that hybridizes to a nucleic acid sequence consisting of SEQ ID NO:234 under stringent hybridization conditions In some embodiments, MAGE family member D1 (MAGED1, NRAGE, DLXIN-1) comprises the amino acid sequence:

(SEQ ID NO: 235; NP_001005332.1)

MAQKMDCGAGLLGFQAEASVEDSALLMQTLMEAIQISEAPPTNQATAA
ASPQSSQPPTANEMADIQVSAAAARPKSAFKVQNATTKGPNGVYDFSQ
AHNAKDVPNTQPKAAFKSQNATPKGPNAAYDFSQAATTGELAANKSEM
AFKAQNATTKVGPNATYNFSQSLNANDLANSRPKTPFKAWNDTTKAPT
ADTQTQNVNQAKMATSQADIETDPGISEPDGATAQTSADGSQAQNLES
RTIIRGKRTRKINNLNVEENSSGDQRRAPLAAGTWRSAPVPVTTQNPP
GAPPNVLWQTPLAWQNPSGWQNQTARQTPPARQSPPARQTPPAWQNPV
AWQNPVIWPNPVIWQNPVIWPNPIVWPGPVVWPNPLAWQNPPGWQTPP
GWQTPPGWQGPPDWQGPPDWPLPPDWPLPPDWPLPTDWPLPPDWIPAD
WPIPPDWQNLRPSPNLRPSPNSRASQNPGAAQPRDVALLQERANKLVK
YLMLKDYTKVPIKRSEMLRDIIREYTDVYPEIIERACFVLEKKFGIQL
KEIDKEEHLYILISTPESLAGILGTTKDTPKLGLLLVILGVIFMNGNR
ASEAVLWEALRKMGLRPGVRHPLLGDLRKLLTYEFVKQKYLDYRRVPN
SNPPEYEFLWGLRSYHETSKMKVLRFIAEVQKRDPRDWTAQFMEAADE

-continued

ALDALDAAAAEAEARAEARTRMGIGDEAVSGPWSWDDIEFELLTWDEE
GDFGDPWSRIPFTFWARYHQNARSRFPQTFAGPIIGPGGTASANFAAN
FGAIGFFWVE, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:235)

In some embodiments, the nucleic acid sequence encoding MAGED1 comprises the nucleic acid sequence:

(SEQ ID NO: 236; NM_001005332.2)

AGCACTTCCGGTCACGCCATCGTTGCTGCCTTCTTCGTCAAGCCCCCA
GGCTCCGCTCTTGCCAGAGGGACAGGAGCCATGGCTCAGAAAATGGAC
TGTGGTGCGGGCCTCCTCGGCTTCCAGGCTGAGGCCTCCGTAGAAGAC
AGCGCCTTGCTTATGCAGACCTTGATGGAGGCCATCCAGATCTCAGAG
GCTCCACCTACTAACCAGGCCACCGCAGCTGCTAGTCCCCAGAGTTCA
CAGCCCCCAACTGCCAATGAGATGGCTGACATTCAGGTTTCAGCAGCT
GCCGCTAGGCCTAAGTCAGCCTTTAAAGTCCAGAATGCCACCACAAAA
GGCCCAAATGGTGTCTATGATTTCTCTCAGGCTCATAATGCCAAGGAT
GTGCCCAACACGCAGCCCAAGGCAGCCTTTAAGTCCCAAAATGCTACC
CCAAAGGGTCCAAATGCTGCCTATGATTTTTCCCAGGCAGCAACCACT
GGTGAGTTAGCTGCTAACAAGTCTGAGATGGCCTTCAAGGCCCAGAAT
GCCACTACTAAAGTGGGCCCAAATGCCACCTACAATTTCTCTCAGTCT
CTCAATGCCAATGACCTGGCCAACAGCAGGCCTAAGACCCCTTTCAAG
GCTTGGAATGATACCACTAAGGCCCCAACAGCTGATACCCAGACCCAG
AATGTAAATCAGGCCAAAATGGCCACTTCCCAGGCTGACATAGAGACC
GACCCAGGTATCTCTGAACCTGACGGTGCAACTGCACAGACATCAGCA
GATGGTTCCCAGGCTCAGAATCTGGAGTCCCGGACAATAATTCGGGGC
AAGAGGACCCGCAAGATTAATAACTTGAATGTTGAAGAGAACAGCAGT
GGGGATCAGAGGCGGGCCCCACTGGCTGCAGGGACCTGGAGGTCTGCA
CCAGTTCCAGTGACCACTCAGAACCCACCTGGCGCACCCCCCAATGTG
CTCTGGCAGACGCCATTGGCTTGGCAGAACCCCTCAGGCTGGCAAAAC
CAGACAGCCAGGCAGACCCCACCAGCACGTCAGAGCCCTCCAGCTAGG
CAGACCCCACCAGCCTGGCAGAACCCAGTCGCTTGGCAGAACCCAGTG
ATTTGGCCAAACCCAGTAATCTGGCAGAACCCAGTGATCTGGCCAAAC
CCCATTGTCTGGCCCGGCCCTGTTGTCTGGCCGAATCCACTGGCCTGG
CAGAATCCACCTGGATGGCAGACTCCACCTGGATGGCAGACCCCACCG
GGCTGGCAGGGTCCTCCAGACTGGCAAGGTCCTCCTGACTGGCCGCTA
CCACCCGACTGGCCACTGCCACCTGATTGGCCACTTCCCACTGACTGG
CCACTACCACCTGACTGGATCCCCGCTGATTGGCCAATTCCACCTGAC
TGGCAGAACCTGCGCCCCTCGCCTAACCTGCGCCCTTCTCCCAACTCG
CGTGCCTCACAGAACCCAGGTGCTGCACAGCCCCGAGATGTGGCCCTT
CTTCAGGAAAGAGCAAATAAGTTGGTCAAGTACTTGATGCTTAAGGAC

-continued

TACACAAAGGTGCCCATCAAGCGCTCAGAAATGCTGAGAGATATCATC

CGTGAATACACTGATGTTTATCCAGAAATCATTGAACGTGCATGCTTT

GTCCTAGAGAAGAAATTTGGGATTCAACTGAAAGAAATTGACAAAGAA

GAACACCTGTATATTCTCATCAGTACCCCCGAGTCCCTGGCTGGCATA

CTGGGAACGACCAAAGACACACCCAAGCTCGGTCTCCTCTTGGTGATT

CTGGGTGTCATCTTCATGAATGGCAACCGTGCCAGTGAGGCTGTCCTC

TGGGAGGCACTACGCAAGATGGGACTGCGTCCTGGGGTGAGACATCCC

CTCCTTGGAGATCTAAGGAAACTTCTCACCTATGAGTTTGTAAAGCAG

AAATACCTGGACTACAGACGAGTGCCCAACAGCAACCCCCCGGAGTAT

GAGTTCCTCTGGGGCCTCCGTTCCTACCATGAGACTAGCAAGATGAAA

GTGCTGAGATTCATTGCAGAGGTTCAGAAAAGAGACCCTCGTGACTGG

ACTGCACAGTTCATGGAGGCTGCAGATGAGGCCTTGGATGCTCTGGAT

GCTGCTGCAGCTGAGGCCGAAGCCCGGGCTGAAGCAAGAACCCGCATG

GGAATTGGAGATGAGGCTGTGTCTGGGCCCTGGAGCTGGGATGACATT

GAGTTTGAGCTGCTGACCTGGGATGAGGAAGGAGATTTTGGAGATCCC

TGGTCCAGAATTCCATTTACCTTCTGGGCCAGATACCACCAGAATGCC

CGCTCCAGATTCCCTCAGACCTTTGCCGGTCCCATTATTGGTCCTGGT

GGTACAGCCAGTGCCAACTTCGCTGCCAACTTTGGTGCCATTGGTTTC

TTCTGGGTTGAGTGAGATGTTGGATATTGCTATCAATCGCAGTAGTCT

TTCCCCTGTGTGAGGCTGAAGCCTCAGATTCCTTCTAAACACAGCTAT

CTAGAGAGCCACATCCTGTTGACTGAAAGTGGCATGCAAGATAAATTT

ATTTGCTGTTCCTTGTCTACTGCTTTTTTTCCCCTTGTGTGCTGTCAA

GTTTTGGTATCAGAAATAAACATTGAAATTGCAAAGTGAA, or a nucleic acid sequence that hybridizes to a nucleic acid sequence consisting of SEQ ID NO:236 under stringent hybridization conditions In some embodiments, SATB homeobox 2 (SATB2, GLSS) comprises the amino acid sequence:

(SEQ ID NO: 237; NP_001165980.1)

MERRSESPCLRDSPDRRSGSPDVKGPPPVKVARLEQNGSPMGARGRPN

GAVAKAVGGLMIPVFCVVEQLDGSLEYDNREEHAEFVLVRKDVLFSQL

VETALLALGYSHSSAAQAQGIIKLGRWNPLPLSYVTDAPDATVADMLQ

DVYHVVTLKIQLQSCSKLEDLPAEQWNHATVRNALKELLKEMNQSTLA

KECPLSQSMISSIVNSTYYANVSATKCQEFGRVVYKKYKKIKVERVER

ENLSDYCVLGQRPMHLPNMNQLASLGKTNEQSPHSQIHHSTPIRNQVP

ALQPIMSPGLLSPQLSPQLVRQQIAMAHLINQQIAVSRLLAHQHPQAI

NQQFLNHPPIPRAVKPEPTNSSVEVSPDIYQQVRDELKRASVSQAVFA

RVAFNRTQGLLSEILRKEEDPRTASQSLLVNLRAMQNFLNLPEVERDR

IYQDERERSMNPNVSMVSSASSSPSSSRTPQAKTSTPTTDLPIKVDGA

NINITAAIYDEIQQEMKRAKVSQALFAKVAANKSQGWLCELLRWKENP

SPENRTLWENLCTIRRFLNLPQHERDVIYEEESRHHHSERMQHVVQLP

PEPVQVLHRQQSQPAKESSPPREEAPPPPPPTEDSCAKKPRSRTKISL

EALGILQSFIHDVGLYPDQEAIHTLSAQLDLPKHTIIKFFQNQRYHVK

HHGKLKEHLGSAVDVAEYKDEELLTESEENDSEEGSEEMYKVEAEEEN

ADKSKAAPAEIDQR, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:237)

In some embodiments, the nucleic acid sequence encoding SATB2 comprises the nucleic acid sequence:

(SEQ ID NO: 238; NM_001172509.2)

GAGTCCGGCTCTGGCTGCTGGCAGAGGCGGCCGAGAGGGGAGAGGCTGGAGGT

GACAGCTTGGGCGGCCGCCGCGTTTCCTCCCGCGCGCGGTCCCGGGTCCCTGCG

TCTTCTCGGCTCTTGGTGTTACCGGTCCCACCGCTCTGGCCGCGCCTCCTCGCGA

GCTAGCCGCCCTGCGAACCAGCAGCCCCGGCTCGCCGCCGCCGCCGCCGCCTCC

GGGTTCTCAGCCCTTTCTCTCCAGAACGGGTCTCCTTCCCGAAGGTGTGAAAAGGC

TCTTTCAGCCTCCTTCTCTTCCCCCCTCCTCCGCCGTCCCCTCCCCCGCTCGCTCG

GGTGTCCCTTTGGAGGAGTCCTTTCCCTCTCCTCCTCCTCCCCCTCCTCCCTCCCC

CCATCATCATCATAACAACCATCTCCGCACCAGAAGAAGACACCCTGACCCAGGAC

CTTAAACATTAGGACCTGGGGAAGAGGGAAGGGGAAGGAGTAAAGAGGAAGACTA

GGAGAACACTGCAAAGCCAAGCACCAGAAACTTTCCACCCTGGATTCTCTACTTTT

GCTCCATGGACAGAGCCCCAGTCAGCCAAGTTTCAGACAGACCGTGAGCAGTCCC

TGTGCGTTTTATTGCGACCTGCCGGTGGGAACTTTGTCTCCGAGTCGGAGCAGCAT

GGAGCGGCGGAGCGAGAGCCCGTGTCTGCGGGACAGCCCCGACCGGCGGAGCG

GCAGCCCGGACGTCAAGGGGCCTCCCCCAGTGAAGGTGGCCCGGCTGGAGCAGA

ACGGCAGCCCCATGGAGCCCGCGGGAGGCCCAACGGCGCCGTGGCCAAGGCC

-continued

GTGGGAGGTTTGATGATTCCTGTCTTTTGTGTCGTGGAGCAGTTGGACGGCTCTCT

TGAATATGACAACAGAGAAGAACACGCCGAGTTTGTCCTGGTGCGGAAAGATGTGC

TTTTTAGCCAGCTGGTGGAGACTGCGCTCCTGGCCCTGGGGTATTCTCACAGCTCT

GCGGCCCAGGCCCAAGGAATAATCAAGCTGGGAAGGTGGAACCCTCTCCCCCTCA

GTTATGTGACAGATGCACCCGACGCGACAGTGGCCGACATGCTACAAGATGTCTAT

CATGTTGTGACGTTGAAAATCCAATTACAAAGTTGTTCAAAGTTGGAAGACTTGCCT

GCGGAGCAGTGGAACCATGCCACAGTCCGCAATGCCTTAAAGGAACTGCTCAAAG

AGATGAACCAGAGCACATTAGCCAAAGAATGCCCTCTCTCCCAGAGTATGATTTCAT

CCATTGTAAATAGCACATATTATGCCAATGTGTCAGCAACCAAGTGCCAGGAGTTTG

GGAGATGGTATAAAAAGTACAAGAAGATTAAAGTGGAAAGAGTGGAACGAGAAAAC

CTTTCAGACTATTGTGTTCTGGGCCAGCGTCCAATGCATTTACCAAATATGAACCAG

CTGGCATCCCTGGGGAAAACCAACGAACAGTCTCCTCACAGCCAAATTCACCACAG

TACTCCAATCCGAAACCAAGTGCCCGCATTACAGCCCATCATGAGCCCTGGTCTTC

TTTCTCCCCAGCTTAGTCCACAACTTGTAAGGCAACAAATAGCCATGGCCCATCTGA

TAAACCAACAGATTGCCGTTAGCCGGCTCCTGGCTCACCAGCATCCTCAAGCCATC

AACCAGCAGTTCCTGAACCATCCACCCATCCCCAGAGCAGTTAAGCCAGAGCCAAC

CAACTCTTCCGTGGAAGTCTCTCCAGATATCTACCAGCAAGTCAGAGATGAGCTGA

AGAGGGCCAGTGTGTCCCAAGCTGTCTTTGCAAGAGTGGCATTCAACCGCACACA

GGGATTGTTGTCTGAGATTCTGCGTAAGGAAGAAGACCCTCGGACAGCCTCTCAGT

CTCTTCTAGTAAACCTGAGGGCCATGCAGAATTTCCTCAATCTGCCAGAAGTGGAG

CGAGATCGCATCTACCAGGATGAGAGGGAGCGGAGCATGAATCCCAATGTGAGCA

TGGTCTCCTCGGCCTCCAGCAGTCCCAGCTCCTCCCGAACCCCTCAGGCCAAAAC

CTCGACACCGACAACAGACCTCCCTATTAAGGTGGACGGCGCCAACATCAACATCA

CAGCTGCCATTTATGACGAGATCCAACAGGAGATGAAAAGGGCCAAGGTGTCTCAA

GCCCTGTTTGCCAAAGTGGCTGCAAATAAAAGTCAGGGCTGGCTGTGTGAACTGCT

CCGCTGGAAGGAGAACCCAAGCCCAGAAAACCGCACCCTCTGGGAAAACCTCTGT

ACCATCCGTCGCTTCCTGAACCTTCCCCAGCATGAGAGGGATGTCATCTATGAGGA

GGAGTCAAGGCATCACCACAGCGAACGCATGCAACACGTGGTCCAGCTTCCCCCT

GAGCCGGTGCAGGTACTTCATAGACAGCAGTCTCAGCCAGCCAAGGAGAGTTCCC

CTCCCAGAGAAGAAGCGCCTCCCCCACCTCCTCCGACTGAAGACAGTTGTGCCAA

AAAGCCCCGGTCTCGCACAAAGATCTCCTTAGAAGCCCTGGGGATCCTCCAAAGCT

TTATTCATGATGTAGGCCTGTACCCAGACCAGGAAGCCATCCACACTCTTTCGGCT

CAGCTGGATCTCCCCAAACACACCATCATCAAGTTCTTCCAGAACCAGCGGTACCA

CGTGAAGCACCACGGGAAGCTGAAAGAGCACCTGGGCTCCGCGGTGGACGTGGC

TGAATATAAGGACGAGGAGCTGCTGACCGAGTCAGAGGAGAACGACAGCGAGGAA

GGCTCCGAGGAGATGTACAAAGTGGAGGCTGAGGAGGAAAATGCTGACAAAAGCA

AGGCAGCACCTGCCGAAATTGACCAGAGATAATGTGAACTTCTACTAGGCAAAGCA

ATACATCGGTCCAAGGATTTTCTGCTTTCATTTCTTTAAAAGTTTTTTGTTAGTTTGTT

TTTTGTTTTTGTTTTTGGGTTTTTTTGGCTTTATTTTTGTCTTTTTATGTCTGTTTTGTT

TTTCTTACCCTTTTGGACATTTCTTTGTTGCACAGGATACACCTATAGACTGAATAAG

-continued

TTCAGTATTTCCGAATCAGACATCGCCTTGGCAAAGACACTAAAGCGTTACACTTTA

TCCCGTCTCTATGACTGGATCATAGTCATTATAATCACAGGAGACTCTGCCTTCATT

ATCCTTGCACTTAACGGAAGTTACATCAGGCAAGTACCAGGATGAAAAGAACTATG

AAATAAATGAAGGAAGCTACAAGTGTGTGTATATGTATATGTATATATCTCTATAT

TTACATATATATATTAAAATTGCATGGGACAGAGACTTTGCAATCCGAAAGAATAGA

CTGTGAAATGAGTTCTTAAAGAAAAGACTTGTTTATGTATTAAAAAAACCACTTCACA

GTGAGTCGCTTTGGCTTTTTGATAAACTGCGGCCTGCTCTCAGGGTGGGGTGACTA

TTTTTGAATTCCTATTTATTTTTTGTGTTTGTCCCTGATTTTTTTTTTTTAATTCTATGG

CTTCCTATCTGGCAGCTTAATGGGTAATTTTTGAGGTATGTATTTAACAAAATAAACG

ACACTGCCGAAAAAAAAAAAAGTGAAGTGAAAACAATCAGGGCACATTAAAATGATA

CAAGTCAAATAAATCTTAAAGACACAATGCACACTTAAAATGACTCAATAAAATGACT

TGCTACGTTCCGTTATTCAATTTGTCATTACTGTAGTGAACAGATGCATTTCTGTGG

AATTCCAAATAAGTAAAACTGAAATTCAGTGCAGAGAAAACTTTGTCCACTAGTGCA

AGTCTTGATCAAATGACATTTTGACATTGGACATATGGAATTCATAGTATGAGCCAC

ATTTTGTTGTGAAATTTATTTACCTGCTTGTGGCTTCAAATCTGAAAATTAATAAGCC

TGCTCGTTTAAAAGTTGTTTGTTGTTGCTGTTTTTTTGTCTTTTTGTTTTTTACTAGAA

AATAGTTCAGTGTAATATTAAGTTAGAAAAGAAGTTGCTGCCCAGTTAAAGGGGCTC

CCTCTCAAATAAATCTCCATCCTTCCCTCTCCCAAAAGACATTTCTGATTTCTGCTTC

ACTTTGGGCTTCCTCTTCTTCGTACACATTCCATCTACCTAATCAAACATTTTCAGTC

CCTGATCTCTCCTGTCCCTTTTCCTGGGATGACAGCCCTAACAAGAACTGTTTTTGA

ATCGTTGTGCAGCTCCAGGCAATAGAGTATGTGAAGCGATTTCAGTAGAATCACTTA

CTCATCCTAAAAGAAAACATTATCCCAGTTACCTACATCGCAATTACCTTATGTAAAG

CAGAACTAATGCTGACTGGATGTTTAATGGGATGAGCATTAAAGCTGCAATCTACTA

TAGTACTCCAGATCTCTTTCGGCTTCCTATGAGAAACACCAGAAGCATTACTTTCCA

CTTCTACTTACAGTAATTGCAAGAGGAGACCTCACATTCAGGACTGCCTAGTGAAC

GTAATCCATGCTTTAAACTGGCCATTAAACAGTCCCACATGGTTGGATTTTTTTTTTT

TTTTTGAGTTGTGCTTTCACAAAACCTTGTCAAAGACCTCATGCAATATCACTTTGAA

AGTTATTTTCTGTTTACTACACAAACATTGTAATATAACTGTTAATACTATTTATATAT

TTGAAAGGTATAAAAGGTAGGAGTTAAAAAAAAAACCTCTATGTGTAGATATTAACT

CAGAACTTACAATATACAGGGAGAAGACATGTTGCAATACAAGCTAATTCTAGCTGC

TCAGTAACCTCTGGAGTTTTTAAAGGGACATTTTCCTGTACTTTTTCAAATAATGATG

TTTAAAAATTATCTTGACATAAGCGTCATATACCTTTGCAAAAGGATGGTTGTTTGCA

GTTAGCCCTGGCCCCATCCTTCCTATTTCTGTAGTATGCTGCAGCTTTAATCAGAAA

GTCCATGGTTGCTGCTTCCTGATCTCCGAGTTACTCTTTCCAAATTGTCTTCTTACA

CTGTTGCTGAAGGTCACTCTGTACACGTAATGGAAACTGATTTTGCCAAGCTCTTAC

AAGGTGGTTCATCTATCGATGGCATCCGCATTTGGTATCTTTTACACTTCAACCAAA

AATTTATTAGGTATTTTTCAATGCTAAGTCTTGCCTTTTATTTTTTAATTTCACTGCCA

AGTTTGCAGTGGTTCTAAGTGAATCTGTGGGCATTTTAGCCTGTGGTCTTGCCAGAT

CTTTGCGAATTACAATGCATATATGTCTATTTATTCAATATCTGTCATATAATATCTAT

TTGGAAGAAGAAACTTTCTCTTGTAGTGCCTCTTGACAAAGCACAATTTCCCGCCTT

TTTTTTTTTTTGTGAAATGAAAAAAACAAATTGTGTTTTATTGCGGTATCAACAATGTG

-continued

AATAAGGATTAACATATTGTAAATGTTCTTTTTTCCATGTAAATCAACTATCTTTGTTA

TCACTAAGTGATAATTAATTTTTAACTTATGTGCATTGTTAGGCTGTTAGAATTTTTTG

GTTGTTAAAATAAACGCATTCAATAAA, or a nucleic acid sequence that hybridizes to a nucleic acid sequence consisting of SEQ ID NO:238 under stringent hybridization conditions In some embodiments, PDZ and LIM domain 7 (LMP3, PDLIM7, LMP1) comprises the amino acid sequence:

(SEQ ID NO: 239; NP_005442.2)

MDSFKVVLEGPAPWGFRLQGGKDFNVPLSISRLTPGGKAAQAGVAVGDWV

LSIDGENAGSLTHIEAQNKIRACGERLSLGLSRAQPVQSKPQKASAPAAD

PPRYTFAPSVSLNKTARPFGAPPPADSAPQQNGQPLRPLVPDASKQRLME

NTEDWRPRPGTGQSRSFRILAHLTGTEFMQDPDEEHLKKSSQVPRTEAPA

PASSTPQEPWPGPTAPSPTSRPPWAVDPAFAERYAPDKTSTVLTRHSQPA

TPTPLQSRTSIVQAAAGGVPGGGSNNGKTPVCHQCHKVIRGRYLVALGHA

YHPEEFVCSQCGKVLEEGGFFEEKGAIFCPPCYDVRYAPSCAKCKKKITG

EIMHALKMTWHVHCFTCAACKTPIRNRAFYMEEGVPYCERDYEKMFGTKC

HGCDFKIDAGDRFLEALGFSWHDTCFVCAICQINLEGKTFYSKKDRPLCK

SHAFSHV, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:239)

In some embodiments, the nucleic acid sequence encoding LMP3 comprises the nucleic acid sequence:

(SEQ ID NO: 240; NM_005451.5)

GTCAGAACACTGGCGGCCGATCCCAACGAGGCTCCCTGGAGCCCGACGCA

GAGCAGCGCCCTGGCCGGGCCAAGCAGGAGCCGGCATCATGGATTCCTTC

AAAGTAGTGCTGGAGGGGCCAGCACCTTGGGGCTTCCGGCTGCAAGGGGG

CAAGGACTTCAATGTGCCCCTCTCCATTTCCCGGCTCACTCCTGGGGGCA

AAGCGGCGCAGGCCGGAGTGGCCGTGGGTGACTGGGTGCTGAGCATCGAT

GGCGAGAATGCGGGTAGCCTCACACACATCGAAGCTCAGAACAAGATCCG

GGCCTGCGGGGAGCGCCTCAGCCTGGGCCTCAGCAGGGCCCAGCCGGTTC

AGAGCAAACCGCAGAAGGCCTCCGCCCCCGCCGCGGACCCTCCGCGGTAC

ACCTTTGCACCCAGCGTCTCCCTCAACAAGACGGCCCGGCCCTTTGGGGC

GCCCCCGCCCGCTGACAGCGCCCCGCAGCAGAATGGACAGCCGCTCCGAC

CGCTGGTCCCAGATGCCAGCAAGCAGCGGCTGATGGAGAACACAGAGGAC

TGGCGGCCGCGGCCGGGGACAGGCCAGTCGCGTTCCTTCCGCATCCTTGC

CCACCTCACAGGCACCGAGTTCATGCAAGACCCGGATGAGGAGCACCTGA

AGAAATCAAGCCAGGTGCCCAGGACAGAAGCCCCAGCCCCAGCCTCATCT

ACACCCCAGGAGCCCTGGCCTGGCCCTACCGCCCCCAGCCCTACCAGCCG

CCCGCCCTGGGCTGTGGACCCTGCGTTTGCCGAGCGCTATGCCCCGGACA

-continued

AAACGAGCACAGTGCTGACCCGGCACAGCCAGCCGGCCACGCCCACGCCG

CTGCAGAGCCGCACCTCCATTGTGCAGGCAGCTGCCGGAGGGGTGCCAGG

AGGGGGCAGCAACAACGGCAAGACTCCCGTGTGTCACCAGTGCCACAAGG

TCATCCGGGGCCGCTACCTGGTGGCGCTGGGCCACGCGTACCACCCGGAG

GAGTTTGTGTGTAGCCAGTGTGGGAAGGTCCTGGAAGAGGGTGGCTTCTT

TGAGGAGAAGGGCGCCATCTTCTGCCCACCATGCTATGACGTGCGCTATG

CACCCAGCTGTGCCAAGTGCAAGAAGAAGATTACAGGCGAGATCATGCAC

GCCCTGAAGATGACCTGGCACGTGCACTGCTTTACCTGTGCTGCCTGCAA

GACGCCCATCCGGAACAGGGCCTTCTACATGGAGGAGGGCGTGCCCTATT

GCGAGCGAGACTATGAGAAGATGTTTGGCACGAAATGCCATGGCTGTGAC

TTCAAGATCGACGCTGGGGACCGCTTCCTGGAGGCCCTGGGCTTCAGCTG

GCATGACACCTGCTTCGTCTGTGCGATATGTCAGATCAACCTGGAAGGAA

AGACCTTCTACTCCAAGAAGGACAGGCCTCTCTGCAAGAGCCATGCCTTC

TCTCATGTGTGAGCCCCTTCTGCCCACAGCTGCCGCGGTGGCCCCTAGCC

TGAGGGGCCTGGAGTCGTGGCCCTGCATTTCTGGGTAGGGCTGGCAATGG

TTGCCTTAACCCTGGCTCCTGGCCCGAGCCTGGGGCTCCCTGGGCCCTGC

CCCACCCACCTTATCCTCCCACCCCACTCCCTCCACCACCACAGCACACC

GGTGCTGGCCACACCAGCCCCCTTTCACCTCCAGTGCCACAATAAACCTG

TACCCAGCTGTG, or a nucleic acid sequence that hybridizes to a nucleic acid sequence consisting of SEQ ID NO:240 under stringent hybridization conditions In some embodiments, POU class 5 homeobox 1 (OCT3, OCT4, POU5F1) comprises the amino acid sequence:

(SEQ ID NO: 241; NP_001167002.1)

MGVLFGKVFSQTTICRFEALQLSFKNMCKLRPLLQKWVEEADNNENLQEI

CKAETLVQARKRKRTSIENRVRGNLENLFLQCPKPTLQQISHIAQQLGLE

KDVVRVWFCNRRQKGKRSSSDYAQREDFEAAGSPFSGGPVSFPLAPGPHF

GTPGYGSPHFTALYSSVPFPEGEAFPPVSVTTLGSPMHSN, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:241)

In some embodiments, the nucleic acid sequence encoding OCT3 comprises the nucleic acid sequence:

(SEQ ID NO: 242; NM_001173531.2)

GGAAAAAAGGAAAGTGCACTTGGAAGAGATCCAAGTGGGCAACTTGAAGA

ACAAGTGCCAAATAGCACTTCTGTCATGCTGGATGTCAGGGCTCTTTGTC

-continued

CACTTTGTATAGCCGCTGGCTTATAGAAGGTGCTCGATAAATCTCTTGAA

TTTAAAAATCAATTAGGATGCCTCTATAGTGAAAAAGATACAGTAAAGAT

GAGGGATAATCAATTTAAAAAATGAGTAAGTACACACAAAGCACTTTATC

CATTCTTATGACACCTGTTACTTTTTTGCTGTGTTTGTGTGTATGCATGC

CATGTTATAGTTTGTGGGACCCTCAAAGCAAGCTGGGGAGAGTATATACT

GAATTTAGCTTCTGAGACATGATGCTCTTCCTTTTTAATTAACCCAGAAC

TTAGCAGCTTATCTATTTCTCTAATCTCAAAACATCCTTAAACTGGGGGT

GATACTTGAGTGAGAGAATTTTGCAGGTATTAAATGAACTATCTTCTTTT

TTTTTTTTCTTTGAGACAGAGTCTTGCTCTGTCACCCAGGCTGGAGTGCA

GTGGCGTGATCTCAGCTCACTGCAACCTCCGCCTCCCGGGTTCAAGTGAT

TCTCCTGCCTCAGCCTCCTGAGTAGCTGGGATTACAGTCCCAGGACATCA

AAGCTCTGCAGAAAGAACTCGAGCAATTTGCCAAGCTCCTGAAGCAGAAG

AGGATCACCCTGGGATATACACAGGCCGATGTGGGGCTCACCCTGGGGGT

TCTATTTGGGAAGGTATTCAGCCAAACGACCATCTGCCGCTTTGAGGCTC

TGCAGCTTAGCTTCAAGAACATGTGTAAGCTGCGGCCCTTGCTGCAGAAG

TGGGTGGAGGAAGCTGACAACAATGAAAATCTTCAGGAGATATGCAAAGC

AGAAACCCTCGTGCAGGCCCGAAAGAGAAAGCGAACCAGTATCGAGAACC

GAGTGAGAGGCAACCTGGAGAATTTGTTCCTGCAGTGCCCGAAACCCACA

CTGCAGCAGATCAGCCACATCGCCCAGCAGCTTGGGCTCGAGAAGGATGT

GGTCCGAGTGTGGTTCTGTAACCGGCGCCAGAAGGGCAAGCGATCAAGCA

GCGACTATGCACAACGAGAGGATTTTGAGGCTGCTGGGTCTCCTTTCTCA

GGGGGACCAGTGTCCTTTCCTCTGGCCCCAGGGCCCCATTTTGGTACCCC

AGGCTATGGGAGCCCTCACTTCACTGCACTGTACTCCTCGGTCCCTTTCC

CTGAGGGGGAAGCCTTTCCCCCTGTCTCCGTCACCACTCTGGGCTCTCCC

ATGCATTCAAACTGAGGTGCCTGCCCTTCTAGGAATGGGGGACAGGGGGA

GGGGAGGAGCTAGGGAAAGAAAACCTGGAGTTTGTGCCAGGGTTTTTGGG

ATTAAGTTCTTCATTCACTAAGGAAGGAATTGGGAACACAAAGGGTGGGG

GCAGGGGAGTTTGGGGCAACTGGTTGGAGGGAAGGTGAAGTTCAATGATG

CTCTTGATTTTAATCCCACATCATGTATCACTTTTTTCTTAAATAAAGAA

GCCTGGGACACAGTAGATAGACACACTTAAAAAAAAAAA, or a nucleic acid sequence that hybridizes to a nucleic acid sequence consisting of SEQ ID NO:242 under stringent hybridization conditions In some embodiments, Kruppel like factor 4 (KLF4, EZF, GKLF) comprises the amino acid sequence:

(SEQ ID NO: 243; NP_001300981.1)

MRQPPGESDMAVSDALLPSFSTFASGPAGREKTLRQAGAPNNRWREELSH

MKRLPPVLPGRPYDLAAATVATDLESGGAGAACGGSNLAPLPRRETEEFN

DLLDLDFILSNSLTHPPESVAATVSSSASASSSSSPSSSGPASAPSTCSF

TYPIRAGNDPGVAPGGTGGGLLYGRESAPPPTAPFNLADINDVSPSGGFV

AELLRPELDPVYIPPQQPQPPGGGLMGKFVLKASLSAPGSEYGSPSVISV

SKGSPDGSHPVVVAPYNGGPPRTCPKIKQEAVSSCTHLGAGPPLSNGHRP

AAHDFPLGRQLPSRTTPTLGLEEVLSSRDCHPALPLPPGFHPHPGPNYPS

FLPDQMQPQVPPLHYQGQSRGFVARAGEPCVCWPHFGTHGMMLTPPSSPL

ELMPPGSCMPEEPKPKRGRRSWPRKRTATHTCDYAGCGKTYTKSSHLKAH

LRTHTGEKPYHCDWDGCGWKFARSDELTRHYRKHTGHRPFQCQKCDRAFS

RSDHLALHMKRHF, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:243)

In some embodiments, the nucleic acid sequence encoding KLF4 comprises the nucleic acid sequence:

(SEQ ID NO: 244; NM_001314052.2)

GGCAGTTTCCCGACCAGAGAGAACGAACGTGTCTGCGGGCGCGCGGGGAGCAGA

GGCGGTGGCGGGCGGCGGCGGCACCGGGAGCCGCCGAGTGACCCTCCCCCGCC

CCTCTGGCCCCCCACCCTCCCACCCGCCCGTGGCCCGCGCCCATGGCCGCGCGC

GCTCCACACAACTCACCGGAGTCCGCGCCTTGCGCCGCCGACCAGTTCGCAGCTC

CGCGCCACGGCAGCCAGTCTCACCTGGCGGCACCGCCCGCCCACCGCCCCGGCC

ACAGCCCCTGCGCCCACGGCAGCACTCGAGGCGACCGCGACAGTGGTGGGGGAC

GCTGCTGAGTGGAAGAGAGCGCAGCCCGGCCACCGGACCTACTTACTCGCCTTGC

TGATTGTCTATTTTTGCGTTTACAACTTTTCTAAGAACTTTTGTATACAAAGGAACTTT

TTAAAAAAGACGCTTCCAAGTTATATTTAATCCAAAGAAGAAGGATCTCGGCCAATT

TGGGGTTTTGGGTTTTGGCTTCGTTTCTTCTCTTCGTTGACTTTGGGGTTCAGGTGC

CCCAGCTGCTTCGGGCTGCCGAGGACCTTCTGGGCCCCCACATTAATGAGGCAGC

CACCTGGCGAGTCTGACATGGCTGTCAGCGACGCGCTGCTCCCATCTTTCTCCAC

GTTCGCGTCTGGCCCGGCGGGAAGGGAGAAGACACTGCGTCAAGCAGGTGCCCC

-continued

GAATAACCGCTGGCGGGAGGAGCTCTCCCACATGAAGCGACTTCCCCCAGTGCTT

CCCGGCCGCCCCTATGACCTGGCGGCGGCGACCGTGGCCACAGACCTGGAGAGC

GGCGGAGCCGGTGCGGCTTGCGGCGGTAGCAACCTGGCGCCCCTACCTCGGAGA

GAGACCGAGGAGTTCAACGATCTCCTGGACCTGGACTTTATTCTCTCCAATTCGCT

GACCCATCCTCCGGAGTCAGTGGCCGCCACCGTGTCCTCGTCAGCGTCAGCCTCC

TCTTCGTCGTCGCCGTCGAGCAGCGGCCCTGCCAGCGCGCCCTCCACCTGCAGCT

TCACCTATCCGATCCGGGCCGGGAACGACCCGGGCGTGGCGCCGGGCGGCACG

GGCGGAGGCCTCCTCTATGGCAGGGAGTCCGCTCCCCCTCCGACGGCTCCCTTCA

ACCTGGCGGACATCAACGACGTGAGCCCCTCGGGCGGCTTCGTGGCCGAGCTCC

TGCGGCCAGAATTGGACCCGGTGTACATTCCGCCGCAGCAGCCGCAGCCGCCAG

GTGGCGGGCTGATGGGCAAGTTCGTGCTGAAGGCGTCGCTGAGCGCCCCTGGCA

GCGAGTACGGCAGCCCGTCGGTCATCAGCGTCAGCAAAGGCAGCCCTGACGGCA

GCCACCCGGTGGTGGTGGCGCCCTACAACGGCGGGCCGCCGCGCACGTGCCCCA

AGATCAAGCAGGAGGCGGTCTCTTCGTGCACCCACTTGGGCGCTGGACCCCCTCT

CAGCAATGGCCACCGGCCGGCTGCACACGACTTCCCCCTGGGGCGGCAGCTCCC

CAGCAGGACTACCCCGACCCTGGGTCTTGAGGAAGTGCTGAGCAGCAGGGACTGT

CACCCTGCCCTGCCGCTTCCTCCCGGCTTCCATCCCCACCCGGGGCCCAATTACC

CATCCTTCCTGCCCGATCAGATGCAGCCGCAAGTCCCGCCGCTCCATTACCAAGGT

CAGTCCCGGGGATTTGTAGCTCGGGCTGGGGAGCCCTGTGTGTGCTGGCCCCACT

TCGGGACACACGGGATGATGCTCACCCCACCTTCTTCACCCCTAGAGCTCATGCCA

CCCGGTTCCTGCATGCCAGAGGAGCCCAAGCCAAAGAGGGGAAGACGATCGTGG

CCCCGGAAAAGGACCGCCACCCACACTTGTGATTACGCGGGCTGCGGCAAAACCT

ACACAAAGAGTTCCCATCTCAAGGCACACCTGCGAACCCACACAGGTGAGAAACCT

TACCACTGTGACTGGGACGGCTGTGGATGGAAATTCGCCCGCTCAGATGAACTGA

CCAGGCACTACCGTAAACACACGGGGCACCGCCCGTTCCAGTGCCAAAAATGCGA

CCGAGCATTTTCCAGGTCGGACCACCTCGCCTTACACATGAAGAGGCATTTTTAAA

TCCCAGACAGTGGATATGACCCACACTGCCAGAAGAGAATTCAGTATTTTTTACTTT

TCACACTGTCTTCCCGATGAGGGAAGGAGCCCAGCCAGAAAGCACTACAATCATG

GTCAAGTTCCCAACTGAGTCATCTTGTGAGTGGATAATCAGGAAAAATGAGGAATC

CAAAAGACAAAAATCAAAGAACAGATGGGGTCTGTGACTGGATCTTCTATCATTCCA

ATTCTAAATCCGACTTGAATATTCCTGGACTTACAAAATGCCAAGGGGGTGACTGGA

AGTTGTGGATATCAGGGTATAAATTATATCCGTGAGTTGGGGGAGGGAAGACCAGA

ATTCCCTTGAATTGTGTATTGATGCAATATAAGCATAAAAGATCACCTTGTATTCTCT

TTACCTTCTAAAAGCCATTATTATGATGTTAGAAGAAGAGGAAGAAATTCAGGTACA

GAAAACATGTTTAAATAGCCTAAATGATGGTGCTTGGTGAGTCTTGGTTCTAAAGGT

ACCAAACAAGGAAGCCAAAGTTTTCAAACTGCTGCATACTTTGACAAGGAAAATCTA

TATTTGTCTTCCGATCAACATTTATGACCTAAGTCAGGTAATATACCTGGTTTACTTC

TTTAGCATTTTTATGCAGACAGTCTGTTATGCACTGTGGTTTCAGATGTGCAATAATT

TGTACAATGGTTTATTCCCAAGTATGCCTTAAGCAGAACAAATGTGTTTTTCTATATA

-continued

GTTCCTTGCCTTAATAAATATGTAATATAAATTTAAGCAAACGTCTATTTTGTATATTT

GTAAACTACAAAGTAAAATGAACATTTTGTGGAGTTTGTATTTTGCATACTCAAGGTG

AGAATTAAGTTTTAAATAAACCTATAATATTTTATCTGAA, or a nucleic acid sequence that hybridizes to a nucleic acid sequence consisting of SEQ ID NO:244 under stringent hybridization conditions In some embodiments, MYC proto-oncogene, bHLH transcription factor (MYC, MRTL, MYCC, c-MC) comprises the amino acid sequence:

(SEQ ID NO: 245; NP_001341799.1)

MDFFRVVENQPPATMPLNVSFTNRNYDLDYDSVQPYFYCDEEENFYQQQQ

QSELQPPAPSEDIWKKFELLPTPPLSPSRRSGLCSPSYVAVTPFSLRGDN

DGGGGSFSTADQLEMVTELLGGDMVNQSFICDPDDETFIKNIIIQDCMWS

GFSAAAKLVSEKLASYQAARKDSGSPNPARGHSVCSTSSLYLQDLSAAAS

ECIDPSVVFPYPLNDSSSPKSCASQDSSAFSPSSDSLLSSTESSPQGSPE

-continued

PLVLHEETPPTTSSDSEEEQEDEEEIDVVSVEKRQAPGKRSESGSPSAGG

HSKPPHSPLVLKRCHVSTHQHNYAAPPSTRKDYPAAKRVKLDSVRVLRQI

SNNRKCTSPRSSDTEENVKRRTHNVLERQRRNELKRSFFALRDQIPELEN

NEKAPKVVILKKATAYILSVQAEEQKLISEEDLLRKRREQLKHKLEQLRN

SCA, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:245)

In some embodiments, the nucleic acid sequence encoding MYC comprises the nucleic acid sequence:

(SEQ ID NO: 246; NM_001354870.1)

GGAGTTTATTCATAACGCGCTCTCCAAGTATACGTGGCAATGCGTTGCTGGGTTATT

TTAATCATTCTAGGCATCGTTTTCCTCCTTATGCCTCTATCATTCCTCCCTATCTACA

CTAACATCCCACGCTCTGAACGCGCGCCCATTAATACCCTTCTTTCCTCCACTCTCC

CTGGGACTCTTGATCAAAGCGCGGCCCTTTCCCCAGCCTTAGCGAGGCGCCCTGC

AGCCTGGTACGCGCGTGGCGTGGCGGTGGGCGCGCAGTGCGTTCTCGGTGTGGA

GGGCAGCTGTTCCGCCTGCGATGATTTATACTCACAGGACAAGGATGCGGTTTGTC

AAACAGTACTGCTACGGAGGAGCAGCAGAGAAAGGGAGAGGGTTTGAGAGGGAG

CAAAAGAAAATGGTAGGCGCGCGTAGTTAATTCATGCGGCTCTCTTACTCTGTTTAC

ATCCTAGAGCTAGAGTGCTCGGCTGCCCGGCTGAGTCTCCTCCCCACCTTCCCCA

CCCTCCCCACCCTCCCCATAAGCGCCCCTCCCGGGTTCCCAAAGCAGAGGGCGTG

GGGGAAAAGAAAAAAGATCCTCTCTCGCTAATCTCCGCCCACCGGCCCTTTATAAT

GCGAGGGTCTGGACGGCTGAGGACCCCCGAGCTGTGCTGCTCGCGGCCGCCACC

GCCGGGCCCCGGCCGTCCCTGGCTCCCCTCCTGCCTCGAGAAGGGCAGGGCTTC

TCAGAGGCTTGGCGGGAAAAAGAACGGAGGGAGGGATCGCGCTGAGTATAAAAGC

CGGTTTTCGGGGCTTTATCTAACTCGCTGTAGTAATTCCAGCGAGAGGCAGAGGGA

GCGAGCGGGCGGCCGGCTAGGGTGGAAGAGCCGGGCGAGCAGAGCTGCGCTGC

GGGCGTCCTGGGAAGGGAGATCCGGAGCGAATAGGGGGCTTCGCCTCTGGCCCA

GCCCTCCCGCTGATCCCCCAGCCAGCGGTCCGCAACCCTTGCCGCATCCACGAAA

CTTTGCCCATAGCAGCGGGCGGGCACTTTGCACTGGAACTTACAACACCCGAGCA

AGGACGCGACTCTCCCGACGCGGGGAGGCTATTCTGCCCATTTGGGGACACTTCC

CCGCCGCTGCCAGGACCCGCTTCTCTGAAAGGCTCTCCTTGCAGCTGCTTAGACG

CTGGATTTTTTTCGGGTAGTGGAAAACCAGCCTCCCGCGACGATGCCCCTCAACGT

TAGCTTCACCAACAGGAACTATGACCTCGACTACGACTCGGTGCAGCCGTATTTCT

ACTGCGACGAGGAGGAGAACTTCTACCAGCAGCAGCAGCAGAGCGAGCTGCAGC

CCCCGGCGCCCAGCGAGGATATCTGGAAGAAATTCGAGCTGCTGCCCACCCCGCC

-continued

CCTGTCCCCTAGCCGCCGCTCCGGGCTCTGCTCGCCCTCCTACGTTGCGGTCACA

CCCTTCTCCCTTCGGGGAGACAACGACGGCGGTGGCGGGAGCTTCTCCACGGCC

GACCAGCTGGAGATGGTGACCGAGCTGCTGGGAGGAGACATGGTGAACCAGAGTT

TCATCTGCGACCCGGACGACGAGACCTTCATCAAAAACATCATCATCCAGGACTGT

ATGTGGAGCGGCTTCTCGGCCGCCGCCAAGCTCGTCTCAGAGAAGCTGGCCTCCT

ACCAGGCTGCGCGCAAAGACAGCGGCAGCCCGAACCCCGCCCGCGGCCACAGCG

TCTGCTCCACCTCCAGCTTGTACCTGCAGGATCTGAGCGCCGCCGCCTCAGAGTG

CATCGACCCCTCGGTGGTCTTCCCCTACCCTCTCAACGACAGCAGCTCGCCCAAGT

CCTGCGCCTCGCAAGACTCCAGCGCCTTCTCTCCGTCCTCGGATTCTCTGCTCTCC

TCGACGGAGTCCTCCCCGCAGGGCAGCCCCGAGCCCCTGGTGCTCCATGAGGAG

ACACCGCCCACCACCAGCAGCGACTCTGAGGAGGAACAAGAAGATGAGGAAGAAA

TCGATGTTGTTTCTGTGGAAAAGAGGCAGGCTCCTGGCAAAAGGTCAGAGTCTGGA

TCACCTTCTGCTGGAGGCCACAGCAAACCTCCTCACAGCCCACTGGTCCTCAAGAG

GTGCCACGTCTCCACACATCAGCACAACTACGCAGCGCCTCCCTCCACTCGGAAG

GACTATCCTGCTGCCAAGAGGGTCAAGTTGGACAGTGTCAGAGTCCTGAGACAGAT

CAGCAACAACCGAAAATGCACCAGCCCCAGGTCCTCGGACACCGAGGAGAATGTC

AAGAGGCGAACACACAACGTCTTGGAGCGCCAGAGGAGGAACGAGCTAAAACGGA

GCTTTTTTGCCCTGCGTGACCAGATCCCGGAGTTGGAAAACAATGAAAAGGCCCCC

AAGGTAGTTATCCTTAAAAAAGCCACAGCATACATCCTGTCCGTCCAAGCAGAGGA

GCAAAAGCTCATTTCTGAAGAGGACTTGTTGCGGAAACGACGAGAACAGTTGAAAC

ACAAACTTGAACAGCTACGGAACTCTTGTGCGTAAGGAAAAGTAAGGAAAACGATT

CCTTCTAACAGAAATGTCCTGAGCAATCACCTATGAACTTGTTTCAAATGCATGATC

AAATGCAACCTCACAACCTTGGCTGAGTCTTGAGACTGAAAGATTTAGCCATAATGT

AAACTGCCTCAAATTGGACTTTGGGCATAAAAGAACTTTTTTATGCTTACCATCTTTT

TTTTTTCTTTAACAGATTTGTATTTAAGAATTGTTTTTAAAAAATTTTAAGATTTACACA

ATGTTTCTCTGTAAATATTGCCATTAAATGTAAATAACTTTAATAAAACGTTTATAGCA

GTTACACAGAATTTCAATCCTAGTATATAGTACCTAGTATTATAGGTACTATAAACCC

TAATTTTTTTTATTTAAGTACATTTTGCTTTTTAAAGTTGATTTTTTTCTATTGTTTTTA

GAAAAAATAAAATAACTGGCAAATATATCATTGAGCCAAATCTTAAGTTGTGAATGTT

TTGTTTCGTTTCTTCCCCCTCCCAACCACCACCATCCCTGTTTGTTTTCATCAATTGC

CCCTTCAGAGGGTGGTCTTAAGAAAGGCAAGAGTTTTCCTCTGTTGAAATGGGTCT

GGGGGCCTTAAGGTCTTTAAGTTCTTGGAGGTTCTAAGATGCTTCCTGGAGACTAT

GATAACAGCCAGAGTTGACAGTTAGAAGGAATGGCAGAAGGCAGGTGAGAAGGTG

AGAGGTAGGCAAAGGAGATACAAGAGGTCAAAGGTAGCAGTTAAGTACACAAAGA

GGCATAAGGACTGGGGAGTTGGGAGGAAGGTGAGGAAGAAACTCCTGTTACTTTA

GTTAACCAGTGCCAGTCCCCTGCTCACTCCAAACCCAGGAATTCTGCCCAGTTGAT

GGGGACACGGTGGGAACCAGCTTCTGCTGCCTTCACAACCAGGCGCCAGTCCTGT

CCATGGGTTATCTCGCAAACCCCAGAGGATCTCTGGGAGGAATGCTACTATTAACC

CTATTTCACAAACAAGGAAATAGAAGAGCTCAAAGAGGTTATGTAACTTATCTGTAG

CCACGCAGATAATACAAAGCAGCAATCTGGACCCATTCTGTTCAAAACACTTAACCC

-continued

TTCGCTATCATGCCTTGGTTCATCTGGGTCTAATGTGCTGAGATCAAGAAGGTTTAG

GACCTAATGGACAGACTCAAGTCATAACAATGCTAAGCTCTATTTGTGTCCCAAGCA

CTCCTAAGCATTTTATCCCTAACTCTACATCAACCCCATGAAGGAGATACTGTTGAT

TTCCCCATATTAGAAGTAGAGAGGGAAGCTGAGGCACACAAAGACTCATCCACATG

CCCAAGATTCACTGATAGGGAAAAGTGGAAGCGAGATTTGAACCCAGGCTGTTTAC

TCCTAACCTGTCCAAGCCACCTCTCAGACGACGGTAGGAATCAGCTGGCTGCTTGT

GAGTACAGGAGTTACAGTCCAGTGGGTTATGTTTTTTAAGTCTCAACATCTAAGCCT

GGTCAGGCATCAGTTCCCCTTTTTTTGTGATTTATTTTGTTTTTATTTTGTTGTTCATT

GTTTAATTTTTCCTTTTACAATGAGAAGGTCACCATCTTGACTCCTACCTTAGCCATT

TGTTGAATCAGACTCATGACGGCTCCTGGGAAGAAGCCAGTTCAGATCATAAAATA

AAACATATTTATTCTTTGTCATGGGAGTCATTATTTTAGAAACTACAAACTCTCCTTG

CTTCCATCCTTTTTTACATACTCATGACACATGCTCATCCTGAGTCCTTGAAAAGGTA

TTTTTGAACATGTGTATTAATTATAAGCCTCTGAAAACCTATGGCCCAAACCAGAAAT

GATGTTGATTATATAGGTAAATGAAGGATGCTATTGCTGTTCTAATTACCTCATTGTC

TCAGTCTCAAAGTAGGTCTTCAGCTCCCTGTACTTTGGGATTTTAATCTACCACCAC

CCATAAATCAATAAATAATTACTTTCTTTGA, or a nucleic acid sequence that hybridizes to a nucleic acid sequence consisting of SEQ ID NO:246 under stringent hybridization conditions In some embodiments, distal-less homeobox 3 (DLX3, AI4, TDO) comprises the amino acid sequence:

(SEQ ID NO: 247; NP_005211.1)

MSGSFDRKLSSILTDISSSLSCHAGSKDSPTLPESSVTDLGYYSAPQHDY

YSGQPYGQTVNPYTYHHQFNLNGLAGTGAYSPKSEYTYGASYRQYGAYRE

QPLPAQDPVSVKEEPEAEVRMVNGKPKKVRKPRTIYSSYQLAALQRRFQK

AQYLALPERAELAAQLGLTQTQVKIWFQNRRSKFKKLYKNGEVPLEHSPN

NSDSMACNSPPSPALWDTSSHSTPAPARSQLPPPLPYSASPSYLDDPTNS

WYHAQNLSGPHLQQQPPQPATLHHASPGPPPNPGAVY, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:247)

In some embodiments, the nucleic acid sequence encoding DLX3 comprises the nucleic acid sequence:

(SEQ ID NO: 248; NM_005220.3)

AGCATTTGATTGTGGCTTGGGACGCGAGGAGAGGCGCGCAGCGACCGCCT

GACGGCAGGCAATGGTGTAAGCGCCTCTCGGCCTCCCCCTCCCCCCAGAC

GCGGCCGGGTCCTCCCTTCGCCTTCTGGACACACACCCCTGCCTCGTCTC

TTCCGCCTCTCTCGCACTCCGGTCCGTTCCTGTCCTCTGCGGAGGCCAGC

CCTGGGGAGGTGCAGCGCCCGCCAGGATGAGTGGCTCCTTCGATCGCAAG

CTCAGCAGCATCCTCACCGACATCTCCAGCTCCCTTAGCTGCCATGCGGG

CTCCAAGGACTCGCCTACCCTGCCCGAGTCTTCTGTCACTGACCTGGGCT

-continued

ACTACAGCGCTCCCCAGCACGATTACTACTCGGGCCAGCCCTATGGCCAG

ACGGTGAACCCCTACACCTACCACCACCAATTCAATCTCAATGGGCTTGC

AGGCACGGGCGCTTACTCGCCCAAGTCGGAATATACCTACGGAGCCTCCT

ACCGGCAATACGGGGCGTATCGGGAGCAGCCGCTGCCAGCCCAGGACCCA

GTGTCGGTGAAGGAGGAGCCGGAAGCAGAGGTGCGCATGGTGAATGGGAA

GCCCAAGAAGGTCCGAAAGCCGCGTACGATCTACTCCAGCTACCAGCTGG

CCGCCCTGCAGCGCCGCTTCCAGAAGGCCCAGTACCTGGCGCTGCCCGAG

CGCGCCGAGCTGGCCGCGCAGCTGGGCCTCACGCAGACACAGGTGAAAAT

CTGGTTCCAGAACCGCCGTTCCAAGTTCAAGAAACTCTACAAGAACGGGG

AGGTGCCGCTGGAGCACAGTCCCAATAACAGTGATTCCATGGCCTGCAAC

TCACCACCATCACCCGCCCTCTGGGACACCTCTTCCCACTCCACTCCGGC

CCCTGCCCGCAGTCAGCTGCCCCCGCCGCTCCCATACAGTGCCTCCCCCA

GCTACCTGGACGACCCCACCAACTCCTGGTATCACGCACAGAACCTGAGT

GGACCCCACTTACAGCAGCAGCCGCCTCAGCCAGCCACCCTGCACCATGC

CTCTCCCGGGCCCCCGCCCAACCCTGGGGCTGTGTACTGAGCACCCATCT

GGCCTGCACCCTTGACAAAGGACCCCAGGACCAGGCAGAAGGCGCCTCCG

TCCTAGCCACTCAGGAATCATCGAGGAGCACAGGGAAAAGGAACTCCCTT

TCCCCCTCCCTTGCCCCTTCCTCCAGGGACCCAAGCGCTTCCAGATGACA

ATTGCATGGACCAAGGATGCCCCCTGAACCTCCCTCCCTCTGCCTAGACA

CTGGGGTACCCCTCCAGATGTGGGGACATTCCACCCCAGTGGGGACAGCC

ATTCCCCTACCTGCTCCAGGAGCCTGGATTGGCTTTAAATGGCTCATCAT

CTTCCAGCTTCTTAAACTTAGTGCCTGTTCCCAGACTGGAGACCTTGGGA

TGGGGGAGAGTGTGGAGGGTTTGCGGGTCCTGCCTGTGCTGGGGCACCTG

-continued

GCACCGTGGATCTTAAAACTTGCCAGGCCTAGTTCCTCCTGAGCCTCTGG

TGGTCTCCCCCTGCTCGAGCGGCCCCTCGGCCAATAAGACAGTGGACATC

ATGACGAGGACTCCGGGTGGGGACCTGAACTGGTCACCGCCCTGCACTTC

TAGCCCTCATTTAAGATTTGAGGGTGAAACCAAAGAAAACCCCCTAAGTG

AGGGAATCTTTTAATATTTGTGGCTTTAGAGGAAAGAACTAAAGGAGCCA

TCTCTCTCCCCTCTCCTCCGTTCCGAGAGGAGGGGTGGGTCTCAGACGTT

TTTCCTATGGACTTATTTCTTCCATGTCCAGGACTTTGCACAACTTTGGT

TTTAAAAGCTGTTGAAAAATAGGAAAACAAAGGGCATTGTTCACAGATAG

GGCCAAGTCTCCCCTTGCAAGGGTGCCTCTGTTCTGTCCCTGCCCCCACC

TCACCTTCTCTACTCCTCCAGTAAGTTGGCAGTTTTGGTGCCAAACCCCA

AATCTCCAAAGAGACATACCAGGCAAGACAAACCCCCAAACACCTCCTTT

CCGGTGGCCTTGGAAACAGATTGCTCCGAGCTGGAGAATGTCGGGTGAGG

TGTATGGGAGAGGAGGGGAGAGTTAGAACTTGTGCCTTTGGGAGTAAGGG

GTAACTGCCTGGAGGGCTGGTGGCACTGCCCCTCCCTGACCCAGACATCC

CACCAAAGCTAACTTTCCCCCACCCCTGATGCAGTAAAACATTGAAAAAA

AAAAAAAAGGAGAGGTAGAAGACTGTAGCTATATATATAAATATATAGTA

AGTTTTTTTTTTTTAAGAGCAACAGAGAGAAGCAGCCTCCTCCCTGCTGC

GGTTTCCTATTTATGTGGCCATGTTCCTCCTGGACGGATCTCCCTGTGTG

TTTCAAGCTGAGAGATGTGGGCTCCGGCTGGATTTGGGTTTTGTGGGAGG

TGCAGGGGCCAAGAGAGACGTGGTAGGTCTCCAAGAGTCCCACCCGGGGG

GGAAGAAGCAAAGCCATCTCCCACCCCCTCCCAGCCTTCTCATTTCTGCT

TTCTTACTGGACTCATCTTTATATATAATGTTAATAAAAAAGACGAAAAT

AA, or a nucleic acid sequence that hybridizes to a nucleic acid sequence consisting of SEQ ID NO:248 under stringent hybridization conditions In some embodiments, distal-less homeobox 5 (DLX5, SHFM1 D) comprises the amino acid sequence:

(SEQ ID NO: 249; NP_005212.1)

MTGVFDRRVPSIRSGDFQAPFQTSAAMHHPSQESPTLPESSATDSDYYS

PTGGAPHGYCSPTSASYGKALNPYQYQYHGVNGSAGSYPAKAYADYSYA

SSYHQYGGAYNRVPSATNQPEKEVTEPEVRMVNGKPKKVRKPRTIYSSF

QLAALQRRFQKTQYLALPERAELAASLGLTQTQVKIWFQNKRSKIKKIM

KNGEMPPEHSPSSSDPMACNSPQSPAVWEPQGSSRSLSHHPHAHPPTSN

QSPASSYLENSASVVYTSAASSINSHLPPPGSLQHPLALASGTLY, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:249)

In some embodiments, the nucleic acid sequence encoding DLX5 comprises the nucleic acid sequence:

(SEQ ID NO: 250; NM_005221.6)

AGCAGTCAGCCGGCCGGAGACAGAGACTTCACGACTCCCAGTCTCCTCC

TCGCCGCGGCCGCCGCCTCCTCCTTCTCTCCTCCTCCTCTTCCTCCTCC

TCCCTCGCTCCCACAGCCATGTCTGCTTAGACCAGAGCAGCCCCACAGC

CAACTAGGGCAGCTGCCGCCGCCACAACAGCAAGGACAGCCGCTGCCGC

CGCCCGTGAGCGATGACAGGAGTGTTTGACAGAAGGGTCCCCAGCATCC

GATCCGGCGACTTCCAAGCTCCGTTCCAGACGTCCGCAGCTATGCACCA

TCCGTCTCAGGAATCGCCAACTTTGCCCGAGTCTTCAGCTACCGATTCT

GACTACTACAGCCCTACGGGGGGAGCCCCGCACGGCTACTGCTCTCCTA

CCTCGGCTTCCTATGGCAAAGCTCTCAACCCCTACCAGTATCAGTATCA

CGGCGTGAACGGCTCCGCCGGGAGCTACCCAGCCAAAGCTTATGCCGAC

TATAGCTACGCTAGCTCCTACCACCAGTACGGCGGCGCCTACAACCGCG

TCCCAAGCGCCACCAACCAGCCAGAGAAAGAAGTGACCGAGCCCGAGGT

GAGAATGGTGAATGGCAAACCAAAGAAAGTTCGTAAACCCAGGACTATT

TATTCCAGCTTTCAGCTGGCCGCATTACAGAGAAGGTTTCAGAAGACTC

AGTACCTCGCCTTGCCGGAACGCGCCGAGCTGGCCGCCTCGCTGGGATT

GACACAAACACAGGTGAAAATCTGGTTTCAGAACAAAAGATCCAAGATC

AAGAAGATCATGAAAAACGGGGAGATGCCCCCGGAGCACAGTCCCAGCT

CCAGCGACCCAATGGCGTGTAACTCGCCGCAGTCTCCAGCGGTGTGGGA

GCCCCAGGGCTCGTCCCGCTCGCTCAGCCACCACCCTCATGCCCACCCT

CCGACCTCCAACCAGTCCCCAGCGTCCAGCTACCTGGAGAACTCTGCAT

CCTGGTACACAAGTGCAGCCAGCTCAATCAATTCCCACCTGCCGCCGCC

GGGCTCCTTACAGCACCCGCTGGCGCTGGCCTCCGGGACACTCTATTAG

ATGGGCTGCTCTCTCTTACTCTCTTTTTTGGGACTACTGTGTTTTGCTG

TTCTAGAAAATCATAAAGAAAGGAATTCATATGGGGAAGTTCGGAAAAC

TGAAAAAGATTCATGTGTAAAGCTTTTTTTTGCATGTAAGTTATTGCAT

TTCAAAAGACCCCCCCTTTTTTTACAGAGGACTTTTTTTGCGCAACTGT

GGACACTTTCAATGGTGCCTTGAAATCTATGACCTCAACTTTTCAAAAG

ACTTTTTTCAATGTTATTTTAGCCATGTAAATAAGTGTAGATAGAGGAA

TTAAACTGTATATTCTGGATAAATAAAATTATTTCGACCATGAAAA, or a nucleic acid sequence that hybridizes to a nucleic acid sequence consisting of SEQ ID NO:250 under stringent hybridization conditions In some embodiments, distal-less homeobox 6 (DLX6) comprises the amino acid sequence:

(SEQ ID NO: 251; NP_005213.3)

MMTMTTMADGLEGQDSSKSAFMEFGQQQQQQQQQQQQQQQQQQQPPPPP

PPPPQPHSQQSSPAMAGAHYPLHCLHSAAAAAAAGSHHHHHHQHHHHGS

PYASGGGNSYNHRSLAAYPYMSHSQHSPYLQSYHNSSAAAQTRGDDTDQ

QKTTVIENGEIRFNGKGKKIRKPRTIYSSLQLQALNHRFQQTQYLALPE

-continued

RAELAASLGLTQTQVKIWFQNKRSKFKKLLKQGSNPHESDPLQGSAALS

PRSPALPPVWDVSASAKGVSMPPNSYMPGYSHWYSSPHQDTMQRPQMM, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:251)

In some embodiments, the nucleic acid sequence encoding DLX6 comprises the nucleic acid sequence:

(SEQ ID NO: 252; NM_005222.4)
ATTCGACTCGTGGCGTCTGCATCAAGTCTGAAAGCAGACGCGCAACTTT

CGCAGAATCCACCTTAAAATCTCTGCCTTAAACTGCACCAGCCCCCAAA

AAATCCAAGGGGGGAAAGCAGGCGGGGGGAGAGCAGATTCCCCCCTCCC

CCTCTCCTCTCCCATCCCTCCTCCTTCCTCCTCCCTTTGAGTTAACAAG

GCCCCGCTCACTATATCTCTTTATATTAAATATATATATATATTAGAGA

AGAGCGAGGGAGAGGGAGAACCACCTCCACCCCCCTCTTTAAATTCTTT

TTTTTTTTTTTTTTTTTTTTTGCAAGGATCCAAAGAGCTAAGGTGGCTG

CAGAGGGGAGAGCGGCGCGAGCCAAGTGGGGGAGGGTGGAGGAAACCCG

GGAGAAGGCTTTCTCCAGCCCCCAAAGTTTTTGATGATGACCATGACTA

CGATGGCTGACGGCTTGGAAGGCCAGGACTCGTCCAAATCCGCCTTCAT

GGAGTTCGGGCAGCAGCAGCAGCAGCAGCAGCAACAGCAGCAGCAGCAG

CAGCAGCAACAGCAACAGCCGCCGCCGCCGCCGCCGCCGCCGCCGCAGC

CGCACTCGCAGCAGAGCTCCCCGGCCATGGCAGGCGCGCACTACCCTCT

GCACTGCCTGCACTCGGCGGCGGCGGCGGCAGCGGCCGGCTCGCACCAC

CACCACCACCACCAGCACCACCACCACGGCTCGCCCTACGCGTCGGGCG

GAGGGAACTCCTACAACCACCGCTCGCTCGCCGCCTACCCCTACATGAG

CCACTCGCAGCACAGCCCTTACCTCCAGTCCTACCACAACAGCAGCGCA

GCCGCCCAGACGCGAGGGGACGACACAGATCAACAAAAACTACAGTGA

TTGAAAACGGGGAAATCAGGTTCAATGGAAAAGGGAAAAAGATTCGGAA

GCCTCGGACCATTTATTCCAGCCTGCAGCTCCAGGCTTTAAACCATCGC

TTTCAGCAGACACAGTATCTGGCCCTTCCAGAGAGAGCCGAACTGGCAG

CTTCCTTAGGACTGACACAAACACAGGTGAAGATATGGTTTCAGAACAA

ACGCTCTAAGTTTAAGAAACTGCTGAAGCAGGGCAGTAATCCTCATGAG

AGCGACCCCCTCCAGGGCTCGGCGGCCCTGTCGCCACGCTCGCCAGCGC

TGCCTCCAGTCTGGGACGTTTCTGCCTCGGCCAAGGGTGTCAGTATGCC

CCCCAACAGCTACATGCCTGGCTATTCTCACTGGTACTCCTCTCCACAC

CAGGACACGATGCAGAGACCACAGATGATGTGAGTTGCCCAAGGGAACA

CCCTAGGGAAACGTCTGAACAAGGAAAAGAGGATCCGGGACCTGCTTGT

ATCTGCGAAAAGGAGCCAAAGGAGCAGGCTTAGGAGAGCTCATAAGTGT

GGCAAGAAGCCGACTAGGCTCATTCTCTCTCCCTCTCTCTCTCTCCC

TCTCCTTTCTTTTTACTTCTTCCTTTCCTCCATTCCTTCTTTCTTTCCT

TTTCCTTTCTACCTTTCTTTTCTTTTTGCCTTTCACCTTTTTTCTCATT

-continued

TACCTTCTCTCTTGAGCAACGTCAGTAATTGATCTTGCATCTCAGAGAG

AGAGAAAGAGCATGTGTGAGAGAGAAACTGGTTTCTATGCCAGCACTCC

TGAAACCCCTTACTGTAAGGATATTTTCTCTTACCCCTTGGGATCCAGG

CTCTGAGTCTCTTCTCTTTGGGAGTATCCATCAAAATGACTTTTTTTAA

AAACAGATTTTCCCCCAACCAGAAGAATCTGCACAAACTTGGCAGCGTT

TTTACTTGTTTAATGAGTTTAAGACATTACATGGTGAAAGAGAAGCATT

TTGGACTCCTGCATTTTTATTTACCATTCCCAGACTGACGAGAAAAAGA

AAATTCCTCACATAACAGCCCTTCTCTAAAGAAAAAGGAAAAAGTGGCT

TTGATTAAAAAAAAACAAAACAAAAACCACTCTTTCCCCACCCCACCCC

CCCAAACCCTGAACTGGAATCAGGAAAGACGGAGGAAACAATCAAAATC

ACCATTCTATTGCTTTGACACCTTTACTAGGTGAATTGGTGGCATTCAC

AAAGCTAATAGGGACGTTTATATCAAGAAACATTTCTGTATATATTGTT

GAATTTTAGTTGTACATATACTTTGTATGTTTTTGTCTTCTTTCATATA

TGGAGTAAAAGCCACAAAACGCTGA, or a nucleic acid sequence that hybridizes to a nucleic acid sequence consisting of SEQ ID NO:252 under stringent hybridization conditions In some embodiments, HOP homeobox2 (OB1, HOD, HOPX, LAGY, TOTO, CAMEO, NECC1, SMAP31) comprises the amino acid sequence:

(SEQ ID NO: 253; NP_001138931.1)
MSAETASGPTEDQVEILEYNFNKVDKHPDSTTLCLIAAEAGLSEEETQK

WFKQRLAKWRRSEGLPSECRSVTD, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:253)

In some embodiments, the nucleic acid sequence encoding OB1 comprises the nucleic acid sequence:

(SEQ ID NO: 254; NM_001145459.1)
GAGACAGAAGGCCGCCTACCGGGGAGGCCGGAGGCCGGCTAGTCGCGGA

CTCGGGCGAACCCACCCTCGCGATCTGTCAAGTCTGTCCCCAGGGGAGG

TCCCCCTTTCGGGAGGAAGTTTTTAAGGGGATTTCTCAAAATCACCCCC

GCGCTTCCTTCACTCCTTCCTTAGAGCCGGAGGTCGGTGAGGGCCCGCG

GAATCATCTATCTCGCCCCCGTCGCAGCGCGCAGGGACCATGTCGGCGG

AGACCGCGAGCGGCCCCACAGAGGACCAGGTGGAAATCCTGGAGTACAA

CTTCAACAAGGTCGACAAGCACCCGGATTCCACCACGCTGTGCCTCATC

GCGGCCGAGGCAGGCCTTTCCGAGGAGGAGACCCAGAAATGGTTTAAGC

AGCGCCTGGCAAAGTGGCGGCGCTCAGAAGGCCTGCCCTCAGAGTGCAG

ATCCGTCACAGACTAAGGAGATGGCAGGCATTGACAGCTTCACTCCATG

AAGGCCATCTCTGTTTCTCTCCTCCGCTTAACCAAGCTGTTGTGGTTTT

TCAGCATAGTGTTGTATGTTCCATTGCTAGCTGTCCTGCTGTTTAACAC

AGTGTTGTATTTTTTTTCTAAATGTACATAATTAGAAAAGAAAATAACA

-continued

ATAGGAAGCTATGTGTATCTTCTGTGTAAAGCAGTGGCTTCACTGGAAA
AATGGTGTGGCTAGCATTTCCCTTTGAGTCATGATGACAGATGGTGTGA
AAACCATCTAAGTTTGCTTTTGACCATCACCTCCCAGTAGCAATTTGCT
TTCATAATCCATTTAGCAATCCAGGCCTCTGTTGAAAAGATAATATGAG
GGAGAAGGGAACACATTTCCTTCTGAACTTACTTCCCTAAGTCACTTTC
CTTATGTATCATCTAATACAATGATGGTTGAGTGAAAATACAGAAGGGG
TGTTTGAGTATTCAGATTTCATAAAACACTTCCTTGGAATATAGCTGCA
TTAACTTGGAAAGAAGCCTGTTGGGCCAGAAGACAGAAACTCCAACTGG
CAAAAAAGCAAGCATCTAAGAAAAAAAAACCACCAAAGTTCTTGAATTTA
CTATATTTAAATGCATTGGTTAAGTTTATTTTGCTAAATAAAGTGAACT
GCTTTTTGTCTCTAAAATGATATTCTAAATAAAACCTTAACTTTTTGTT
GAAGATGCACTGAAAAAAAAAA, or a nucleic acid sequence that hybridizes to a nucleic acid sequence consisting of SEQ ID NO:254 under stringent hybridization conditions In some embodiments, CCAAT enhancer binding protein alpha (CEBPA, CEBP C/EBP) comprises the amino acid sequence:

(SEQ ID NO: 255; NP_001272758.1)
MPGGAHGPPPGYGCAAAGYLDGRLEPLYERVGAPALRPLVIKQEPREED
EAKQLALAGLFPYQPPPPPPPSHPHPHPPPAHLAAPHLQFQIAHCGQTT
MHLQPGHPTPPPTPVPSPHPAPALGAAGLPGPGSALKGLGAAHPDLRAS
GGSGAGKAKKSVDKNSNEYRVRRERNNIAVRKSRDKAKQRNVETQQKVL
ELTSDNDRLRKRVEQLSRELDTLRGIFRQLPESSLVKAMGNCA, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:255)

In some embodiments, the nucleic acid sequence encoding CEBP comprises the nucleic acid sequence:

(SEQ ID NO: 256; NM_001285829.1)
TATAAAAGCTGGGCCGGCGCGGGCCGGGCCATTCGCGACCCGGAGGTGC
GCGGGCGCGGGCGAGCAGGGTCTCCGGGTGGGCGGCGGCGACGCCCCGC
GCAGGCTGGAGGCCGCCGAGGCTCGCCATGCCGGGAGAACTCTAACTCC
CCCATGGAGTCGGCCGACTTCTACGAGGCGGAGCCGCGGCCCCCGATGA
GCAGCCACCTGCAGAGCCCCCCGCACGCGCCCAGCAGCGCCGCCTTCGG
CTTTCCCCGGGGCGCGGGCCCCGCGCAGCCTCCCGCCCCACCTGCCGCC
CCGGAGCCGCTGGGCGGCATCTGCGAGCACGAGACGTCCATCGACATCA
GCGCCTACATCGACCCGGCCGCCTTCAACGACGAGTTCCTGGCCGACCT
GTTCCAGCACAGCCGGCAGCAGGAGAAGGCCAAGGCGGCCGTGGGCCCC
ACGGGCGGCGGCGGCGGCGGCGACTTTGACTACCCGGGCGCGCCCGCGG
GCCCCGGCGGCGCCGTCATGCCCGGGGGAGCGCACGGGCCCCCGCCCGG
CTACGGCTGCGCGGCCGCCGGCTACCTGGACGGCAGGCTGGAGCCCCTG

-continued

TACGAGCGCGTCGGGGCGCCGGCGCTGCGGCCGCTGGTGATCAAGCAGG
AGCCCCGCGAGGAGGATGAAGCCAAGCAGCTGGCGCTGGCCGGCCTCTT
CCCTTACCAGCCGCCGCCGCCGCCGCCGCCCTCGCACCCGCACCCGCAC
CCGCCGCCCGCGCACCTGGCCGCCCCGCACCTGCAGTTCCAGATCGCGC
ACTGCGGCCAGACCACCATGCACCTGCAGCCCGGTCACCCCACGCCGCC
GCCCACGCCCGTGCCCAGCCCGCACCCCGCGCCCGCGCTCGGTGCCGCC
GGCCTGCCGGGCCCTGGCAGCGCGCTCAAGGGGCTGGGCGCCGCGCACC
CCGACCTCCGCGCGAGTGGCGGCAGCGGCGCGGGCAAGGCCAAGAAGTC
GGTGGACAAGAACAGCAACGAGTACCGGGTGCGGCGCGAGCGCAACAAC
ATCGCGGTGCGCAAGAGCCGCGACAAGGCCAAGCAGCGCAACGTGGAGA
CGCAGCAGAAGGTGCTGGAGCTGACCAGTGACAATGACCGCCTGCGCAA
GCGGGTGGAACAGCTGAGCCGCGAACTGGACACGCTGCGGGGCATCTTC
CGCCAGCTGCCAGAGAGCTCCTTGGTCAAGGCCATGGGCAACTGCGCGT
GAGGCGCGCGGCTGTGGGACCGCCCTGGGCCAGCCTCCGGCGGGGACCC
AGGGAGTGGTTTGGGGTCGCCGGATCTCGAGGCTTGCCCGAGCCGTGCG
AGCCAGGACTAGGAGATTCCGGTGCCTCCTGAAAGCCTGGCCTGCTCCG
CGTGTCCCCTCCCTTCCTCTGCGCCGGACTTGGTGCGTCTAAGATGAGG
GGGCCAGGCGGTGGCTTCTCCCTGCGAGGAGGGGAGAATTCTTGGGGCT
GAGCTGGGAGCCCGGCAACTCTAGTATTTAGGATAACCTTGTGCCTTGG
AAATGCAAACTCACCGCTCCAATGCCTACTGAGTAGGGGGAGCAAATCG
TGCCTTGTCATTTTATTTGGAGGTTTCCTGCCTCCTTCCCGAGGCTACA
GCAGACCCCCATGAGAGAAGGAGGGGAGCAGGCCCGTGGCAGGAGGAGG
GCTCAGGGAGCTGAGATCCCGACAAGCCCGCCAGCCCCAGCCGCTCCTC
CACGCCTGTCCTTAGAAAGGGGTGGAAACATAGGGACTTGGGGCTTGGA
ACCTAAGGTTGTTCCCCTAGTTCTACATGAAGGTGGAGGGTCTCTAGTT
CCACGCCTCTCCCACCTCCCTCCGCACACACCCCACCCCAGCCTGCTAT
AGGCTGGGCTTCCCCTTGGGGCGGAACTCACTGCGATGGGGGTCACCAG
GTGACCAGTGGGAGCCCCCACCCCGAGTCACACCAGAAAGCTAGGTCGT
GGGTCAGCTCTGAGGATGTATACCCCTGGTGGGAGAGGGAGACCTAGAG
ATCTGGCTGTGGGGCGGGCATGGGGGGTGAAGGGCCACTGGGACCCTCA
GCCTTGTTTGTACTGTATGCCTTCAGCATTGCCTAGGAACACGAAGCAC
GATCAGTCCATCCCAGAGGGACCGGAGTTATGACAAGCTTTCCAAATAT
TTTGCTTTATCAGCCGATATCAACACTTGTATCTGGCCTCTGTGCCCCA
GCAGTGCCTTGTGCAATGTGAATGTGCGCGTCTCTGCTAAACCACCATT
TTATTTGGTTTTTGTTTTGTTTTGGTTTTGCTCGGATACTTGCCAAAAT
GAGACTCTCCGTCGGCAGCTGGGGGAAGGGTCTGAGACTCCCTTTCCTT
TTGGTTTTGGGATTACTTTTGATCCTGGGGGACCAATGAGGTGAGGGGG
GTTCTCCTTTGCCCTCAGCTTTCCCCAGCCCCTCCGGCCTGGGCTGCCC
ACAAGGCTTGTCCCCCAGAGGCCCTGGCTCCTGGTCGGGAAGGGAGGTG
GCCTCCCGCCAACGCATCACTGGGGCTGGGAGCAGGGAAGGACGGCTTG

-continued

GTTCTCTTCTTTTGGGGAGAACGTAGAGTCTCACTCTAGATGTTTTATG

TATTATATCTATAATATAAACATATCAAAGTCAA, or a nucleic acid sequence that hybridizes to a nucleic acid sequence consisting of SEQ ID NO:256 under stringent hybridization conditions In some embodiments, activating transcription factor 4 (ATF4, CREB2, TXREB) comprises the amino acid sequence:

(SEQ ID NO: 257; NP_001666.2)

MTEMSFLSSEVLVGDLMSPFDQSGLGAEESLGLLDDYLEVAKHFKPHGF

SSDKAKAGSSEWLAVDGLVSPSNNSKEDAFSGTDWMLEKMDLKEFDLDA

LLGIDDLETMPDDLLTTLDDTCDLFAPLVQETNKQPPQTVNPIGHLPES

LTKPDQVAPFTFLQPLPLSPGVLSSTPDHSFSLELGSEVDITEGDRKPD

YTAYVAMIPQCIKEEDTPSDNDSGICMSPESYLGSPQHSPSTRGSPNRS

LPSPGVLCGSARPKPYDPPGEKMVAAKVKGEKLDKKLKKMEQNKTAATR

YRQKKRAEQEALTGECKELEKKNEALKERADSLAKEIQYLKDLIEEVRK

ARGKKRVP, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:257)

In some embodiments, the nucleic acid sequence encoding ATF4 comprises the nucleic acid sequence:

(SEQ ID NO: 258; NM_001675.4)

AGCCATTTCTACTTTGCCCGCCCACAGATGTAGTTTTCTCTGCGCGTGT

GCGTTTTCCCTCCTCCCCGCCCTCAGGGTCCACGGCCACCATGGCGTAT

TAGGGGCAGCAGTGCCTGCGGCAGCATTGGCCTTTGCAGCGGCGGCAGC

AGCACCAGGCTCTGCAGCGGCAACCCCCAGCGGCTTAAGCCATGGCGTG

AGTACCGGGGCGGGTCGTCCAGCTGTGCTCCTGGGGCCGGCGCGGGTTT

TGGATTGGTGGGGTGCGGCCTGGGGCCAGGGCGGTGCCGCCAAGGGGGA

AGCGATTTAACGAGCGCCCGGGACGCGTGGTCTTTGCTTGGGTGTCCCC

GAGACGCTCGCGTGCCTGGGATCGGGAAAGCGTAGTCGGGTGCCCGGAC

TGCTTCCCCAGGAGCCCTACAGCCCTCGGACCCCGAGCCCCGCAAGGGT

CCCAGGGGTCTTGGCTGTTGCCCCACGAAACGTGGCAGGAACCAAGATG

GCGGCGGCAGGGCGGCGGCGCGGGCGTGAGTCAAGGGCGGGCGGTGGGC

GGGGCGCGGCCGCCCTGGCCGTATTTGGACGTGGGGACGGAGCGCTTTC

CTCTTGGCGGCCGGTGGAAGAATCCCCTGGTCTCCGTGAGCGTCCATTT

TGTGGAACCTGAGTTGCAAGCAGGGAGGGGCAAATACAACTGCCCTGTT

CCCGATTCTCTAGATGGCCGATCTAGAGAAGTCCCGCCTCATAAGTGGA

AGGATGAAATTCTCAGAACAGCTAACCTCTAATGGGAGTTGGCTTCTGA

TTCTCATTCAGGCTTCTCACGGCATTCAGCAGCAGCGTTGCTGTAACCG

ACAAAGACACCTTCGAATTAAGCACATTCCTCGATTCCAGCAAAGCACC

GCAACATGACCGAAATGAGCTTCCTGAGCAGCGAGGTGTTGGTGGGGGA

-continued

CTTGATGTCCCCCTTCGACCAGTCGGGTTTGGGGGCTGAAGAAAGCCTA

GGTCTCTTAGATGATTACCTGGAGGTGGCCAAGCACTTCAAACCTCATG

GGTTCTCCAGCGACAAGGCTAAGGCGGGCTCCTCCGAATGGCTGGCTGT

GGATGGGTTGGTCAGTCCCTCCAACAACAGCAAGGAGGATGCCTTCTCC

GGGACAGATTGGATGTTGGAGAAAATGGATTTGAAGGAGTTCGACTTGG

ATGCCCTGTTGGGTATAGATGACCTGGAAACCATGCCAGATGACCTTCT

GACCACGTTGGATGACACTTGTGATCTCTTTGCCCCCCTAGTCCAGGAG

ACTAATAAGCAGCCCCCCCAGACGGTGAACCCAATTGGCCATCTCCCAG

AAAGTTTAACAAAACCCGACCAGGTTGCCCCCTTCACCTTCTTACAACC

TCTTCCCCTTTCCCCAGGGGTCCTGTCCTCCACTCCAGATCATTCCTTT

AGTTTAGAGCTGGGCAGTGAAGTGGATATCACTGAAGGAGATAGGAAGC

CAGACTACACTGCTTACGTTGCCATGATCCCTCAGTGCATAAAGGAGGA

AGACACCCCTTCAGATAATGATAGTGGCATCTGTATGAGCCCAGAGTCC

TATCTGGGGTCTCCTCAGCACAGCCCCTCTACCAGGGGCTCTCCAAATA

GGAGCCTCCCATCTCCAGGTGTTCTCTGTGGGTCTGCCCGTCCCAAACC

TTACGATCCTCCTGGAGAGAAGATGGTAGCAGCAAAAGTAAAGGGTGAG

AAACTGGATAAGAAGCTGAAAAAAATGGAGCAAAACAAGACAGCAGCCA

CTAGGTACCGCCAGAAGAAGAGGGCGGAGCAGGAGGCTCTTACTGGTGA

GTGCAAAGAGCTGGAAAAGAAGAACGAGGCTCTAAAAGAGAGGGCGGAT

TCCCTGGCCAAGGAGATCCAGTACCTGAAAGATTTGATAGAAGAGGTCC

GCAAGGCAAGGGGGAAGAAAAGGGTCCCCTAGTTGAGGATAGTCAGGAG

CGTCAATGTGCTTGTACATAGAGTGCTGTAGCTGTGTGTTCCAATAAAT

TATTTTGTAGGGAAAGTAAAAAAAAAAAAAAA, or a nucleic acid sequence that hybridizes to a nucleic acid sequence consisting of SEQ ID NO:258 under stringent hybridization conditions In some embodiments, SMAD family member 1 (SMAD1) comprises the amino acid sequence:

(SEQ ID NO: 259; NP_001003688.1)

MNVTSLFSFTSPAVKRLLGWKQGDEEEKWAEKAVDALVKKLKKKKGAME

ELEKALSCPGQPSNCVTIPRSLDGRLQVSHRKGLPHVIYCRVWRWPDLQ

SHHELKPLECCEFPFGSKQKEVCINPYHYKRVESPVLPPVLVPRHSEYN

PQHSLLAQFRNLGQNEPHMPLNATFPDSFQQPNSHPFPHSPNSSYPNSP

GSSSSTYPHSPTSSDPGSPFQMPADTPPPAYLPPEDPMTQDGSQPMDTN

MMAPPLPSEINRGDVQAVAYEEPKHWCSIVYYELNNRVGEAFHASSTSV

LVDGFTDPSNNKNRFCLGLLSNVNRNSTIENTRRHIGKGVHLYYVGGEV

YAECLSDSSIFVQSRNCNYHHGFHPTTVCKIPSGCSLKIFNNQEFAQLL

AQSVNHGFETVYELTKMCTIRMSFVKGWGAEYHRQDVTSTPCWIEIHLH

GPLQWLDKVLTQMGSPHNPISSVS,

SVS. (SEQ ID NO:259; NP_001003688.1), or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:259)

In some embodiments, the nucleic acid sequence encoding SMAD1 comprises the nucleic acid sequence:

(SEQ ID NO: 260; NM_001003688.1)

CACTGCATGTGTATTCGTGAGTTCGCGGTTGAACAACTGTTCCTTTACT
CTGCTCCCTGTCTTTGTGCTGACTGGGTTACTTTTTTAAACACTAGGAA
TGGTAATTTCTACTCTTCTGGACTTCAAACTAAGAAGTTAAAGAGACTT
CTCTGTAAATAAACAAATCTCTTCTGCTGTCCTTTTGCATTTGGAGACA
GCTTTATTTCACCATATCCAAGGAGTATAACTAGTGCTGTCATTATGAA
TGTGACAAGTTTATTTTCCTTTACAAGTCCAGCTGTGAAGAGACTTCTT
GGGTGGAAACAGGGCGATGAAGAAGAAAAATGGGCAGAGAAAGCTGTTG
ATGCTTTGGTGAAAAAACTGAAGAAAAAGAAAGGTGCCATGGAGGAACT
GGAAAAGGCCTTGAGCTGCCCAGGGCAACCGAGTAACTGTGTCACCATT
CCCCGCTCTCTGGATGGCAGGCTGCAAGTCTCCCACCGGAAGGGACTGC
CTCATGTCATTTACTGCCGTGTGTGGCGCTGGCCCGATCTTCAGAGCCA
CCATGAACTAAAACCACTGGAATGCTGTGAGTTTCCTTTTGGTTCCAAG
CAGAAGGAGGTCTGCATCAATCCCTACCACTATAAGAGAGTAGAAAGCC
CTGTACTTCCTCCTGTGCTGGTTCCAAGACACAGCGAATATAATCCTCA
GCACAGCCTCTTAGCTCAGTTCCGTAACTTAGGACAAAATGAGCCTCAC
ATGCCACTCAACGCCACTTTTCCAGATTCTTTCCAGCAACCCAACAGCC
ACCCGTTTCCTCACTCTCCCAATAGCAGTTACCCAAACTCTCCTGGGAG
CAGCAGCAGCACCTACCCTCACTCTCCCACCAGCTCAGACCCAGGAAGC
CCTTTCCAGATGCCAGCTGATACGCCCCCACCTGCTTACCTGCCTCCTG
AAGACCCCATGACCCAGGATGGCTCTCAGCCGATGGACACAAACATGAT
GGCGCCTCCCCTGCCCTCAGAAATCAACAGAGGAGATGTTCAGGCGGTT
GCTTATGAGGAACCAAAACACTGGTGCTCTATTGTCTACTATGAGCTCA
ACAATCGTGTGGGTGAAGCGTTCCATGCCTCCTCCACAAGTGTGTTGGT
GGATGGTTTCACTGATCCTTCCAACAATAAGAACCGTTTCTGCCTTGGG
CTGCTCTCCAATGTTAACCGGAATTCCACTATTGAAAACACCAGGCGGC
ATATTGGAAAAGGAGTTCATCTTTATTATGTTGGAGGGGAGGTGTATGC
CGAATGCCTTAGTGACAGTAGCATCTTTGTGCAAAGTCGGAACTGCAAC
TACCATCATGGATTTCATCCTACTACTGTTTGCAAGATCCCTAGTGGGT
GTAGTCTGAAAATTTTTAACAACCAAGAATTTGCTCAGTTATTGGCACA
GTCTGTGAACCATGGATTTGAGACAGTCTATGAGCTTACAAAAATGTGT
ACTATACGTATGAGCTTTGTGAAGGGCTGGGGAGCAGAATACCACCGCC
AGGATGTTACTAGCACCCCCTGCTGGATTGAGATACATCTGCACGGCCC
CCTCCAGTGGCTGGATAAAGTTCTTACTCAAATGGGTTCACCTCATAAT
CCTATTTCATCTGTATCTTAAATGGCCCCAGGCATCTGCCTCTGGAAAA
CTATTGAGCCTTGCATGTACTTGAAGGATGGATGAGTCAGACACGATTG
AGAACTGACAAAGGAGCCTTGATAATACTTGACCTCTGTGACCAACTGT
TGGATTCAGAAATTTAAACAAAAAAAAAAAAAAACACACACACCTTGGT

-continued

AACATACTGTTGATATCAAGAACCTGTTTAGTTTACATTGTAACATTCT
ATTGTAAAATCAACTAAAATTCAGACTTTTAGCAGGACTTTGTGTACAG
TTAAAGGAGAGATGGCCAAGCCAGGGACAAATTGTCTATTAGAAAACGG
TCCTAAGAGATTCTTTGGTGTTTGGCACTTTAAGGTCATCGTTGGGCAG
AAGTTTAGCATTAATAGTTGTTCTGAAACGTGTTTTATCAGGTTTAGAG
CCCATGTTGAGTCTTCTTTTCATGGGTTTTCATAATATTTTAAAACTAT
TTGTTTAGCGATGGTTTTGTTCGTTTAAGTAAAGGTTAATCTTGATGAT
ATACATAATAATCTTTCTAAAATTGTATGCTGACCATACTTGCTGTCAG
AATAATGCTAGGCATATGCTTTTTGCTAAATATGTATGTACAGAGTATT
TGGAAGTTAAGAATTGATTAGACTAGTGAATTTAGGAGTATTTGAGGTG
GGTGGGGGGAAGAGGGAAATGACAACTGCAAATGTAGACTATACTGTAA
AAATTCAGTTTGTTGCTTTAAAGAAACAAACTGATACCTGAATTTTGCT
GTGTTTCCATTTTTTAGAGATTTTTATCATTTTTTTCTCTCTCGGCATT
CTTTTTTCTCATACTCTTCAAAAAGCAGTTCTGCAGCTGGTTAATTCAT
GTAACTGTGAGAGCAAATGAATAATTCCTGCTATTCTGAAATTGCCTAC
ATGTTTCAATACCAGTTATATGGAGTGCTTGAATTTAATAAGCAGTTTT
TACGGAGTTTACAGTACAGAAATAGGCTTTAATTTTCAAGTGAATTTTT
TGCCAAACTTAGTAACTCTGTTAAATATTTGGAGGATTTAAAGAACATC
CCAGTTTGAATTCATTTCAAACTTTTTAAATTTTTTTGTACTATGTTTG
GTTTTATTTTCCTTCTGTTAATCTTTTGTATTCACTTATGCTCTCGTAC
ATTGAGTACTTTTATTCCAAAACTAGTGGGTTTTCTCTACTGGAAATTT
TCAATAAACCTGTCATTATTGCTTACTTTGATTAAAA, or a nucleic acid sequence that hybridizes to a nucleic acid sequence consisting of SEQ ID NO:260 under stringent hybridization conditions In some embodiments, menin 1 (MEN1, MEAT, SCG2) comprises the amino acid sequence:

(SEQ ID NO: 261; NP_000235.2NP_001180.1)

MGLKAAQKTLFPLRSIDDVVRLFAAELGREEPDLVLLSLVLGFVEHFLA
VNRVIPTNVPELTFQPSPAPDPPGGLTYFPVADLSIIAALYARFTAQIR
GAVDLSLYPREGGVSSRELVKKVSDVIWNSLSRSYFKDRAHIQSLFSFI
TGWSPVGTKLDSSGVAFAVVGACQALGLRDVHLALSEDHAWVVFGPNGE
QTAEVTWHGKGNEDRRGQTVNAGVAERSWLYLKGSYMRCDRKMEVAFMV
CAINPSIDLHTDSLELLQLQQKLLWLLYDLGHLERYPMALGNLADLEEL
EPTPGRPDPLTLYHKGIASAKTYYRDEHIYPYMYLAGYHCRNRNVREAL
QAWADTATVIQDYNYCREDEEIYKEFFEVANDVIPNLLKEAASLLEAGE
ERPGEQSQGTQSQGSALQDPECFAHLLRFYDGICKWEEGSPTPVLHVGW
ATFLVQSLGRFEGQVRQKVRIVSREAEAAEAEEPWGEEAREGRRRGPRR
ESKPEEPPPPKKPALDKGLGTGQGAVSGPPRKPPGTVAGTARGPEGGST
AQVPAPAASPPPEGPVLTFQSEKMKGMKELLVATKINSSAIKLQLTAQS
QVQMKKQKVSTPSDYTLSFLKRQRKGL, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:261)

In some embodiments, the nucleic acid sequence encoding MEN1 comprises the nucleic acid sequence:

(SEQ ID NO: 262; NM_000244.3)

```
GGTGTCCGGAGCCGCGGACCTAGAGATCCCAGAAGCCACAGCGCAGCGG
CCCGGCCCGCCACTATTTCCAGGCTCAGCGGGGCAGGGGCCGCCGCCCA
CCGCCCGCCGCCATGGGGCTGAAGGCCGCCCAGAAGACGCTGTTCCCGC
TGCGCTCCATCGACGACGTGGTGCGCCTGTTTGCTGCCGAGCTGGGCCG
AGAGGAGCCGGACCTGGTGCTCCTTTCCTTGGTGCTGGGCTTCGTGGAG
CATTTTCTGGCTGTCAACCGCGTCATCCCTACCAACGTTCCCGAGCTCA
CCTTCCAGCCCAGCCCCGCCCCCGACCCGCCTGGCGGCCTCACCTACTT
TCCCGTGGCCGACCTGTCTATCATCGCCGCCCTCTATGCCCGCTTCACC
GCCCAGATCCGAGGCGCCGTCGACCTGTCCCTCTATCCTCGAGAAGGGG
GTGTCTCCAGCCGTGAGCTGGTGAAGAAGGTCTCCGATGTCATATGGAA
CAGCCTCAGCCGCTCCTACTTCAAGGATCGGGCCCACATCCAGTCCCTC
TTCAGCTTCATCACAGGTTGGAGCCCAGTAGGCACCAAATTGGACAGCT
CCGGTGTGGCCTTTGCTGTGGTTGGGGCCTGCCAGGCCCTGGGTCTCCG
GGATGTCCACCTCGCCCTGTCTGAGGATCATGCCTGGGTAGTGTTTGGG
CCCAATGGGGAGCAGACAGCTGAGGTCACCTGGCACGGCAAGGGCAACG
AGGACCGCAGGGGCCAGACAGTCAATGCCGGTGTGGCTGAGCGGAGCTG
GCTGTACCTGAAAGGATCATACATGCGCTGTGACCGCAAGATGGAGGTG
GCGTTCATGGTGTGTGCCATCAACCCTTCCATTGACCTGCACACCGACT
CGCTGGAGCTTCTGCAGCTGCAGCAGAAGCTGCTCTGGCTGCTCTATGA
CCTGGGACATCTGGAAAGGTACCCCATGGCCTTAGGGAACCTGGCAGAT
CTAGAGGAGCTGGAGCCCACCCCTGGCCGGCCAGACCCACTCACCCTCT
ACCACAAGGGCATTGCCTCAGCCAAGACCTACTATCGGGATGAACACAT
CTACCCCTACATGTACCTGGCTGGCTACCACTGTCGCAACCGCAATGTG
CGGGAAGCCCTGCAGGCCTGGGCGGACACGGCCACTGTCATCCAGGACT
ACAACTACTGCCGGGAAGACGAGGAGATCTACAAGGAGTTCTTTGAAGT
AGCCAATGATGTCATCCCCAACCTGCTGAAGGAGGCAGCCAGCTTGCTG
GAGGCGGGCGAGGAGCGGCCGGGGGAGCAAAGCCAGGGCACCCAGAGCC
AAGGTTCCGCCCTCCAGGACCCTGAGTGCTTCGCCCACCTGCTGCGATT
CTACGACGGCATCTGCAAATGGGAGGAGGGCAGTCCCACGCCTGTGCTG
CACGTGGGCTGGGCCACCTTTCTTGTGCAGTCCCTAGGCCGTTTTGAGG
GACAGGTGCGGCAGAAGGTGCGCATAGTGAGCCGAGAGGCCGAGGCGGC
CGAGGCCGAGGAGCCGTGGGGCGAGGAAGCCCGGGAAGGCCGGCGGCGG
GGCCCACGGCGGGAGTCCAAGCCAGAGGAGCCCCCGCCGCCCAAGAAGC
CAGCACTGGACAAGGGCCTGGGCACCGGCCAGGGTGCAGTGTCAGGACC
CCCCCGGAAGCCTCCTGGGACTGTCGCTGGCACAGCCCGAGGCCCTGAA
GGTGGCAGCACGGCTCAGGTGCCAGCACCCGCAGCATCACCACCGCCGG
AGGGTCCAGTGCTCACTTTCCAGAGTGAGAAGATGAAGGGCATGAAGGA
```

-continued

```
GCTGCTGGTGGCCACCAAGATCAACTCGAGCGCCATCAAGCTGCAACTC
ACGGCACAGTCGCAAGTGCAGATGAAGAAGCAGAAAGTGTCCACCCCTA
GTGACTACACTCTGTCTTTCCTCAAGCGGCAGCGCAAAGGCCTCTGAAC
TACTGGGGACTTCGGACCGCTTGTGGGGACCCAGGCTCCGCCCTTAGTC
CCCCAACTCTGAGCCCATGTTCTGCCCCCAGCCCAAAGGGGACAGGCCT
CACCTCTACCCAAACCCTAGGTTCCCGGTCCCGAGTACAGTCTGTATCA
AACCCACGATTTTCTCCAGCTCAGAACCCAGGGCTCTGCCCCAGTCGTT
AGAATATAGGTCTCTTCTCCCAGAATCCCAGCCGGCCAATGGAAACCTC
ACGCTGGGTCCTAATTACCAGTCTTTAAAGGCCCAGCCCCTAGAAACCC
AAGCTCCTCCTCGGAACCGCTCACCTAGAGCCAGACCAACGTTACTCAG
GGCTCCTCCCAGCTTGTAGGAGCTGAGGTTTCACCCTTAACCCAAGGAG
CACAGGTCCCACCTCCAGCCCGGGAGCCTAGGACCACTCAGCCCCTAGG
AGTATATTTCCGCACTTCAGAATTCCATATCTTGCGAATCCAAGCTCCC
TGCCCCAAATAACTTCAGTCCTGCTCCAGAATTTGGAAATCCTAGTTTC
CTCTCCTTCGTATCCCGAGTCTGGGACACAAAACTCCGCCCCCAGCCTA
TGAGCATCCTGAGCCCCGCCCTCTTCCTGACGAAACTGGCCCCGGATCA
GAGCAGGACCTCCCTTCCGACCCTCTGGGAACCTCCCAGAGGTCCAGCC
CATCTCGGAGCATCCCGGAGGAAATCTGCAGAGGGTTAGGAGTGGGTGA
CAAGAGCCTGATCTCTTCCTGTTTTGTACATAGATTTATTTTTCAGTTC
CAAGAAAGATGAATACATTTTGTTAAAAAAAATAAAAAAAA,
```

or a nucleic acid sequence that hybridizes to a nucleic acid sequence consisting of SEQ ID NO:262 under stringent hybridization conditions In some embodiments, msh homeobox 1 (MSX1, HOX7, HYD1, ECTD3, SThaG1) comprises the amino acid sequence:

(SEQ ID NO: 263; NP_002439.2)

```
MAPAADMTSLPLGVKVEDSAFGKPAGGGAGQAPSAAAATAAAMGADEEGA
KPKVSPSLLPFSVEALMADHRKPGAKESALAPSEGVQAAGGSAQPLGVPP
GSLGAPDAPSSPRPLGHFSVGGLLKLPEDALVKAESPEKPERTPWMQSPR
FSPPPARRLSPPACTLRKHKTNRKPRTPFTTAQLLALERKFRQKQYLSIA
ERAEFSSSLSLTETQVKIWFQNRRAKAKRLQEAELEKLKMAAKPMLPPAA
FGLSFPLGGPAAVAAAAGASLYGASGPFQRAALPVAPVGLYTAHVGYSMY
HLT,
```

or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:263)

In some embodiments, the nucleic acid sequence encoding MSX comprises the nucleic acid sequence:

(SEQ ID NO: 264; NM_002448.3)

```
AGGGCCCGGAGCCGGCGAGTGCTCCCGGGAACTCTGCCTGCGCGGCGGCA
GCGACCGGAGGCCAGGCCCAGCACGCCGGAGCTGGCCTGCTGGGGAGGGG
```

-continued

CGGGAGGCGCGCGCGGGAGGGTCCGCCCGGCCAGGGCCCCGGGCGCTCGC

AGAGGCCGGCCGCGCTCCCAGCCCGCCCGGAGCCCATGCCCGGCGGCTGG

CCAGTGCTGCGGCAGAAGGGGGGGCCCGGCTCTGCATGGCCCCGGCTGCT

GACATGACTTCTTTGCCACTCGGTGTCAAAGTGGAGGACTCCGCCTTCGG

CAAGCCGGCGGGGGGAGGCGCGGGCCAGGCCCCCAGCGCCGCCGCGGCCA

CGGCAGCCGCCATGGGCGCGGACGAGGAGGGGGCCAAGCCCAAAGTGTCC

CCTTCGCTCCTGCCCTTCAGCGTGGAGGCGCTCATGGCCGACCACAGGAA

GCCGGGGGCCAAGGAGAGCGCCCTGGCGCCCTCCGAGGGCGTGCAGGCGG

CGGGTGGCTCGGCGCAGCCACTGGGCGTCCCGCCGGGGTCGCTGGGAGCC

CCGGACGCGCCCTCTTCGCCGCGGCCGCTCGGCCATTTCTCGGTGGGGGG

ACTCCTCAAGCTGCCAGAAGATGCGCTCGTCAAAGCCGAGAGCCCCGAGA

AGCCCGAGAGGACCCCGTGGATGCAGAGCCCCCGCTTCTCCCCGCCGCCG

GCCAGGCGGCTGAGCCCCCCAGCCTGCACCCTCCGCAAACACAAGACGAA

CCGTAAGCCGCGGACGCCCTTCACCACCGCGCAGCTGCTGGCGCTGGAGC

GCAAGTTCCGCCAGAAGCAGTACCTGTCCATCGCCGAGCGCGCGGAGTTC

TCCAGCTCGCTCAGCCTCACTGAGACGCAGGTGAAGATATGGTTCCAGAA

CCGCCGCGCCAAGGCAAAGAGACTACAAGAGGCAGAGCTGGAGAAGCTGA

AGATGGCCGCCAAGCCCATGCTGCCACCGGCTGCCTTCGGCCTCTCCTTC

CCTCTCGGCGGCCCCGCAGCTGTAGCGGCCGCGGCGGGTGCCTCGCTCTA

CGGTGCCTCTGGCCCCTTCCAGCGCGCCGCGCTGCCTGTGGCGCCCGTGG

GACTCTACACGGCCCATGTGGGCTACAGCATGTACCACCTGACATAGAGG

GTCCCAGGTCGCCCACCTGTGGGCCAGCCGATTCCTCCAGCCCTGGTGCT

GTACCCCCGACGTGCTCCCCTGCTCGGCACCGCCAGCCGCCTTCCCTTTA

ACCCTCACACTGCTCCAGTTTCACCTCTTTGCTCCCTGAGTTCACTCTCC

GAAGTCTGATCCCTGCCAAAAAGTGGCTGGAAGAGTCCCTTAGTACTCTT

CTAGCATTTAGATCTACACTCTCGAGTTAAAGATGGGGAAACTGAGGGCA

GAGAGGTTAACAGATTTATCTAAGGTCCCCAGCAGAATTGACAGTTGAAC

AGAGCTAGAGGCCATGTCTCCTGCATAGCTTTTCCCTGTCCTGACACCAG

GCAAGAAAAGCGCAGAGAAATCGGTGTCTGACGATTTTGGAAATGAGAAC

AATCTCAAAAAAAAAAAAAAAAAAAAAAAAAAAAAAAAAAAAGAAAAGAG

AAAAAAAAGACTAGCCAGCCAGGAAGATGAATCCTAGCTTCTTCCATTGG

AAAATTTAAGACAAGTTCAACAACAAAACATTTGCTCTGGGGGGCAGGGA

AAACACAGATGTGTTGCAAAGGTAGGTTGAAGGGACCTCTCTCTTACCAG

TACCAGAAACACAATTGTAAAATTAAAAAAAAAAAAAAACTCTTTCTATT

TAACAGTACATTTGTGTGGCTCTCAAACATCCCTTTGGAAGGGATTGTGT

GTACTATGTAATATACTGTATATTTGAAATTTTATTATCATTTATATTAT

AGCTATATTTGTTAAATAAATTAATTTTAAGCTACAAAAA, or a nucleic acid sequence that hybridizes to a nucleic acid sequence consisting of SEQ ID NO:264 under stringent hybridization conditions In some embodiments, msh homeobox 2 (MSX2, FPP, MSH, PFM, CRS2, HOX8, PFM1) comprises the amino acid sequence:

(SEQ ID NO: 265; NP_001350555.1)

MASPSKGNDLFSPDEEGPAVVAGPGPGPGGAEGAAEERRVKVSSLPFSVE

ALMSDKKPPKEASPLPAESASAGATLRPLLLSGHGAREAHSPGPLVKPFE

TASVKSENSEDGAAWMQEPGRYSPPPSECAPGQE, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:265)

In some embodiments, the nucleic acid sequence encoding MSX2 comprises the nucleic acid sequence:

(SEQ ID NO: 266; NM_001363626.2)

GCAGCAAAAAAGTTTGAGTCGCCGCTGCCGGGTTGCCAGCGGAGTCGCGC

GTCGGGAGCTACGTAGGGCAGAGAAGTCATGGCTTCTCCGTCCAAAGGCA

ATGACTTGTTTTCGCCCGACGAGGAGGGCCCAGCAGTGGTGGCCGGACCA

GGCCCGGGGCCTGGGGGCGCCGAGGGGGCCGCGGAGGAGCGCCGCGTCAA

GGTCTCCAGCCTGCCCTTCAGCGTGGAGGCGCTCATGTCCGACAAGAAGC

CGCCCAAGGAGGCGTCCCCGCTGCCGGCCGAAAGCGCCTCGGCCGGGGCC

ACCCTGCGGCCACTGCTGCTGTCGGGGCACGGCGCTCGGGAAGCGCACAG

CCCCGGGCCGCTGGTGAAGCCCTTCGAGACCGCCTCGGTCAAGTCGGAAA

ATTCAGAAGATGGAGCGGCGTGGATGCAGGAACCCGGCCGATATTCGCCG

CCGCCAAGTGAGTGCGCGCCGGGGCAGGAGTAGGAGGACATATGAGCCCT

ACCACCTGCACCCTGAGGAAACACAAGACCAATCGGAAGCCGCGCACGCC

CTTTACCACATCCCAGCTCCTCGCCCTGGAGCGCAAGTTCCGTCAGAAAC

AGTACCTCTCCATTGCAGAGCGTGCAGAGTTCTCCAGCTCTCTGAACCTC

ACAGAGACCCAGGTCAAAATCTGGTTCCAGAACCGAAGGGCCAAGGCGAA

AAGACTGCAGGAGGCAGAACTGGAAAAGCTGAAAATGGCTGCAAAACCTA

TGCTGCCCTCCAGCTTCAGTCTCCCTTTCCCCATCAGCTCGCCCCTGCAG

GCAGCGTCCATATATGGAGCATCCTACCCGTTCCATAGACCTGTGCTTCC

CATCCCGCCTGTGGGACTCTATGCCACGCCAGTGGGATATGGCATGTACC

ACCTGTCCTAAGGAAGACCAGATCAATAGACTCCATGATGGATGCTTGTT

TCAAAGGGTTTCCTCTCCCTCTCCACGAAGGCAGTACCAGCCAGTACTCC

TGCTCTGCTAACCCTGCGTGCACCACCCTAAGCGGCTAGGCTGACAGGGC

CACACGACATAGCTGAAATTTGTTCTGTAGGCGGAGGCACCAAGCCCTGT

TTTCTTGGTGTAATCTTCCAGATGCCCCCTTTTCCTTTCACAAAGATTGG

CTCTGATGGTTTTTATGTATAAATATATATATATAATAAAATATAATACA

TTTTTATACAGCAGACGTAAAAATTCAAATTATTTTAAAAGGCAAAATTT

ATATACATATGTGCTTTTTTTCTATATCTCACCTTCCCAAAAGACACTGT

GTAAGTCCATTTGTTGTATTTTCTTAAAGAGGGAGACAAATTATTTGCAA

AATGTGCTAAAGTCAATGATTTTTACGGGATTATTGACTTCTGCTTATGG

AAAACAAAGAAACAGACACAATGCACACAGAAAATATTAGATATGGAGAG

ATTATTCAAAGTGAAGGGGACACATCATATTTCTGCATTTTACTTGCATT

AAAAGAAACCTCTTTATATACTACAGTTGTTCCTATCTCTCCCCCGCCCC

-continued

```
CCACCGCCCCACCACACACATATTTTTAAAGTTTTTCCTTTTTTAAGAAT
ATTTTTGTAAGACCAATACCTGGGATGAGAAGAATCCTGAGACTGCCTGG
AGGTGAGGTAGAAAATTAGAAATACTTCCTAATTCTTCTCAAGGCTGTTG
GTAACTTTATTTCAGATAATTGGAGAGTAAAATGTTAAAACCTGTTGAGA
GGAATTGATGGTTTCTGAGAAATACTAGGTACATTCATCCTCACAGATTG
CAAAGGTGATTTGGGTGGGGGTTTAGTAATTTTCTGCTTAAAAAATGAGT
ATCTTGTAACCATTACCTATATGCTAAATATTCTTGAACAATTAGTAGAT
CCAGAAAGAAAAAAAAATATGCTTTCTCTGTGTGTGTACCTGTTGTATGT
CCTAAACTTATTAGAAAATTTTATATACTTTTTTACATGTTGGGGGGCAG
AAGGTAAAGCCATGTTTTGACTTGGTGAAAATGGGATTGTCAAACAGCCC
ATTAAGTTCCCTGGTATTTCACCTTCCTGTCCATCTGTCCCCTCCCTCCG
GTATACCTTTATCCCTTTGAAAGGGTGCTTGTACAATTTGATATATTTTA
TTGAAGAGTTATCTCTTATTCTGAATTAAATTAAGCATTTGTTTTATTGC
AGTAAAGTTTGTCCAAACTCACAA,
```

or a nucleic acid sequence that hybridizes to a nucleic acid sequence consisting of SEQ ID NO:266 under stringent hybridization conditions In some embodiments, neurofibromin 1 (NF1, WSS, NFNS, VRNF) comprises the amino acid sequence:

```
                             (SEQ ID NO: 267; NP_000258.1)
MAAHRPVEWVQAVVSRFDEQLPIKTGQQNTHTKVSTEHNKECLINISKYK
FSLVISGLTTILKNVNNMRIFGEAAEKNLYLSQLIILDTLEKCLAGQPKD
TMRLDETMLVKQLLPEICHFLHTCREGNQHAAELRNSASGVLFSLSCNNF
NAVFSRISTRLQELTVCSEDNVDVHDIELLQYINVDCAKLKRLLKETAFK
FKALKKVAQLAVINSLEKAFWNWVENYPDEFTKLYQIPQTDMAECAEKLF
DLVDGFAESTKRKAAVWPLQIILLILCPEIIQDISKDVVDENNMNKKLFL
DSLRKALAGHGGSRQLTESAAIACVKLCKASTYINWEDNSVIFLLVQSMV
VDLKNLLFNPSKPFSRGSQPADVDLMIDCLVSCFRISPHNNQHFKICLAQ
NSPSTFHYVLVNSLHRIITNSALDWWPKIDAVYCHSVELRNMFGETLHKA
VQGCGAHPAIRMAPSLTFKEKVTSLKFKEKPTDLETRSYKYLLLSMVKLI
HADPKLLLCNPRKQGPETQGSTAELITGLVQLVPQSHMPEIAQEAMEALL
VLHQLDSIDLWNPDAPVETFWEISSQMLFYICKKLTSHQMLSSTEILKWL
REILICRNKFLLKNKQADRSSCHFLLFYGVGCDIPSSGNTSQMSMDHEEL
LRTPGASLRKGKGNSSMDSAAGCSGTPPICRQAQTKLEVALYMFLWNPDT
EAVLVAMSCFRHLCEEADIRCGVDEVSVHNLLPNYNTFMEFASVSNMMST
GRAALQKRVMALLRRIEHPTAGNTEAWEDTHAKWEQATKLILNYPKAKME
DGQAAESLHKTIVKRRMSHVSGGGSIDLSDTDSLQEWINMTGFLCALGGV
CLQQRSNSGLATYSPPMGPVSERKGSMISVMSSEGNADTPVSKFMDRLLS
LMVCNHEKVGLQIRTNVKDLVGLELSPALYPMLFNKLKNTISKFFDSQGQ
VLLTDTNTQFVEQTIAIMKNLLDNHTEGSSEHLGQASIETMMLNLVRYVR
VLGNMVHAIQIKTKLCQLVEVMMARRDDLSFCQEMKFRNKMVEYLTDWVM
GTSNQAADDDVKCLTRDLDQASMEAVVSLLAGLPLQPEEGDGVELMEAKS
```

-continued

```
QLFLKYFTLFMNLLNDCSEVEDESAQTGGRKRGMSRRLASLRHCTVLAMS
NLLNANVDSGLMHSIGLGYHKDLQTRATFMEVLTKILQQGTEFDTLAETV
LADRFERLVELVTMMGDQGELPIAMALANVVPCSQWDELARVLVTLFDSR
HLLYQLLWNMFSKEVELADSMQTLFRGNSLASKIMTFCFKVYGATYLQKL
LDPLLRIVITSSDWQHVSFEVDPTRLEPSESLEENQRNLLQMTEKFFHAI
ISSSSEFPPQLRSVCHCLYQVVSQRFPQNSIGAVGSAMFLRFINPAIVSP
YEAGILDKKPPPRIERGLKLMSKILQSIANHVLFTKEEHMRPFNDFVKSN
FDAARRFFLDIASDCPTSDAVNHSLSFISDGNVLALHRLLWNNQEKIGQY
LSSNRDHKAVGRRPFDKMATLLAYLGPPEHKPVADTHWSSLNLTSSKFEE
FMTRHQVHEKEEFKALKTLSIFYQAGTSKAGNPIFYYVARRFKTGQINGD
LLIYHVLLTLKPYYAKPYEIVVDLTHTGPSNRFKTDFLSKWFVVFPGFAY
DNVSAVYIYNCNSWVREYTKYHERLLTGLKGSKRLVFIDCPGKLAEHIEH
EQQKLPAATLALEEDLKVFHNALKLAHKDTKVSIKVGSTAVQVTSAERTK
VLGQSVFLNDIYYASEIEEICLVDENQFTLTIANQGTPLTFMHQECEAIV
QSIIHIRTRWELSQPDSIPQHTKIRPKDVPGTLLNIALLNLGSSDPSLRS
AAYNLLCALTCTFNLKIEGQLLETSGLCIPANNTLFIVSISKTLAANEPH
LTLEFLEECISGFSKSSIELKHLCLEYMTPWLSNLVRFCKHNDDAKRQRV
TAILDKLITMTINEKQMYPSIQAKIWGSLGQITDLLDVVLDSFIKTSATG
GLGSIKAEVMADTAVALASGNVKLVSSKVIGRMCKIIDKTCLSPTPTLEQ
HLMWDDIAILARYMLMLSFNNSLDVAAHLPYLFHVVTFLVATGPLSLRAS
THGLVINIIHSLCTCSQLHFSEETKQVLRLSLTEFSLPKFYLLFGISKVK
SAAVIAFRSSYRDRSFSPGSYERETFALTSLETVTEALLEIMEACMRDIP
TCKWLDQVVTELAQRFAFQYNPSLQPRALVVFGCISKRVSHGQIKQIIRI
LSKALESCLKGPDTYNSQVLIEATVIALTKLQPLLNKDSPLHKALFWVAV
AVLQLDEVNLYSAGTALLEQNLHTLDSLRIFNDKSPEEVFMAIRNPLEWH
CKQMDHFVGLNFNSNFNFALVGHLLKGYRHPSPAIVARTVRILHTLLTLV
NKHRNCDKFEVNTQSVAYLAALLTVSEEVRSRCSLKHRKSLLLTDISMEN
VPMDTYPIHHGDPSYRTLKETQPWSSPKGSEGYLAATYPTVGQTSPRARK
SMSLDMGQPSQANTKKLLGTRKSFDHLISDTKAPKRQEMESGITTPPKMR
RVAETDYEMETQRISSSQQHPHLRKVSVSESNVLLDEEVLTDPKIQALLL
TVLATLVKYTTDEFDQRILYEYLAEASVVFPKVFPVVHNLLDSKINTLLS
LCQDPNLLNPIFIGIVQSVVYHEESPPQYQTSYLQSFGFNGLWRFAGPFS
KQTQIPDYAELIVKFLDALIDTYLPGIDEETSEESLLTPTSPYPPALQSQ
LSITANLNLSNSMTSLATSQHSPGIDKENVELSPTTGHCNSGRTRHGSAS
QVQKQRSAGSFKRNSIKKIV,
```

or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:267)

In some embodiments, the nucleic acid sequence encoding NF1 comprises the nucleic acid sequence:

(SEQ ID NO: 268; NM_000267.3)

AATCTCTAGCTCGCTCGCGCTCCCTCTCCCCGGGCCGTGGAAAGGATCCCACTTC

CGGTGGGGTGTCATGGCGGCGTCTCGGACTGTGATGGCTGTGGGGAGACGGCGC

TAGTGGGGAGAGCGACCAAGAGGCCCCCTCCCCTCCCCGGGTCCCCTTCCCCTAT

CCCCCTCCCCCCAGCCTCCTTGCCAACGCCCCCTTTCCCTCTCCCCCTCCCGCTC

GGCGCTGACCCCCCATCCCCACCCCCGTGGGAACACTGGGAGCCTGCACTCCACA

GACCCTCTCCTTGCCTCTTCCCTCACCTCAGCCTCCGCTCCCCGCCCTCTTCCCGG

CCCAGGGCGCCGGCCCACCCTTCCCTCCGCCGCCCCCCGGCCGCGGGGAGGAC

ATGGCCGCGCACAGGCCGGTGGAATGGGTCCAGGCCGTGGTCAGCCGCTTCGAC

GAGCAGCTTCCAATAAAAACAGGACAGCAGAACACACATACCAAAGTCAGTACTGA

GCACAACAAGGAATGTCTAATCAATATTTCCAAATACAAGTTTTCTTTGGTTATAAGC

GGCCTCACTACTATTTTAAAGAATGTTAACAATATGAGAATATTTGGAGAAGCTGCT

GAAAAAAATTTATATCTCTCTCAGTTGATTATATTGGATACACTGGAAAAATGTCTTG

CTGGGCAACCAAAGGACACAATGAGATTAGATGAAACGATGCTGGTCAAACAGTTG

CTGCCAGAAATCTGCCATTTTCTTCACACCTGTCGTGAAGGAAACCAGCATGCAGC

TGAACTTCGGAATTCTGCCTCTGGGGTTTATTTTCTCTCAGCTGCAACAACTTCAA

TGCAGTCTTTAGTCGCATTTCTACCAGGTTACAGGAATTAACTGTTTGTTCAGAAGA

CAATGTTGATGTTCATGATATAGAATTGTTACAGTATATCAATGTGGATTGTGCAAAA

TTAAAACGACTCCTGAAGGAAACAGCATTTAAATTTAAAGCCCTAAAGAAGGTTGCG

CAGTTAGCAGTTATAAATAGCCTGGAAAAGGCATTTTGGAACTGGGTAGAAAATTAT

CCAGATGAATTTACAAAACTGTACCAGATCCCACAGACTGATATGGCTGAATGTGCA

GAAAAGCTATTTGACTTGGTGGATGGTTTTGCTGAAAGCACCAAACGTAAAGCAGC

AGTTTGGCCACTACAAATCATTCTCCTTATCTTGTGTCCAGAAATAATCCAGGATATA

TCCAAAGACGTGGTTGATGAAAACAACATGAATAAGAAGTTATTTCTGGACAGTCTA

CGAAAAGCTCTTGCTGGCCATGGAGGAAGTAGGCAGCTGACAGAAAGTGCTGCAA

TTGCCTGTGTCAAACTGTGTAAAGCAAGTACTTACATCAATTGGGAAGATAACTCTG

TCATTTTCCTACTTGTTCAGTCCATGGTGGTTGATCTTAAGAACCTGCTTTTTAATCC

AAGTAAGCCATTCTCAAGAGGCAGTCAGCCTGCAGATGTGGATCTAATGATTGACT

GCCTTGTTTCTTGCTTTCGTATAAGCCCTCACAACAACCAACACTTTAAGATCTGCC

TGGCTCAGAATTCACCTTCTACATTTCACTATGTGCTGGTAAATTCACTCCATCGAA

TCATCACCAATTCCGCATTGGATTGGTGGCCTAAGATTGATGCTGTGTATTGTCACT

CGGTTGAACTTCGAAATATGTTTGGTGAAACACTTCATAAAGCAGTGCAAGGTTGTG

GAGCACACCCAGCAATACGAATGGCACCGAGTCTTACATTTAAAGAAAAAGTAACA

AGCCTTAAATTTAAAGAAAAACCTACAGACCTGGAGACAAGAAGCTATAAGTATCTT

CTCTTGTCCATGGTGAAACTAATTCATGCAGATCCAAAGCTCTTGCTTTGTAATCCA

AGAAAACAGGGGCCCGAAACCCAAGGCAGTACAGCAGAATTAATTACAGGGCTCG

TCCAACTGGTCCCTCAGTCACACATGCCAGAGATTGCTCAGGAAGCAATGGAGGCT

CTGCTGGTTCTTCATCAGTTAGATAGCATTGATTTGTGGAATCCTGATGCTCCTGTA

GAAACATTTTGGGAGATTAGCTCACAAATGCTTTTTTACATCTGCAAGAAATTAACTA

GTCATCAAATGCTTAGTAGCACAGAAATTCTCAAGTGGTTGCGGGAAATATTGATCT

-continued

GCAGGAATAAATTTCTTCTTAAAAATAAGCAGGCAGATAGAAGTTCCTGTCACTTTC

TCCTTTTTTACGGGGTAGGATGTGATATTCCTTCTAGTGGAAATACCAGTCAAATGT

CCATGGATCATGAAGAATTACTACGTACTCCTGGAGCCTCTCTCCGGAAGGGAAAA

GGGAACTCCTCTATGGATAGTGCAGCAGGATGCAGCGGAACCCCCCCGATTTGCC

GACAAGCCCAGACCAAACTAGAAGTGGCCCTGTACATGTTTCTGTGGAACCCTGAC

ACTGAAGCTGTTCTGGTTGCCATGTCCTGTTTCCGCCACCTCTGTGAGGAAGCAGA

TATCCGGTGTGGGGTGGATGAAGTGTCAGTGCATAACCTCTTGCCCAACTATAACA

CATTCATGGAGTTTGCCTCTGTCAGCAATATGATGTCAACAGGAAGAGCAGCACTT

CAGAAAAGAGTGATGGCACTGCTGAGGCGCATTGAGCATCCCACTGCAGGAAACA

CTGAGGCTTGGGAAGATACACATGCAAAATGGGAACAAGCAACAAAGCTAATCCTT

AACTATCCAAAAGCCAAAATGGAAGATGGCCAGGCTGCTGAAAGCCTTCACAAGAC

CATTGTTAAGAGGCGAATGTCCCATGTGAGTGGAGGAGGATCCATAGATTTGTCTG

ACACAGACTCCCTACAGGAATGGATCAACATGACTGGCTTCCTTTGTGCCCTTGGG

GGAGTGTGCCTCCAGCAGAGAAGCAATTCTGGCCTGGCAACCTATAGCCCACCCA

TGGGTCCAGTCAGTGAACGTAAGGGTTCTATGATTTCAGTGATGTCTTCAGAGGGA

AACGCAGATACACCTGTCAGCAAATTTATGGATCGGCTGTTGTCCTTAATGGTGTGT

AACCATGAGAAAGTGGGACTTCAAATACGGACCAATGTTAAGGATCTGGTGGGTCT

AGAATTGAGTCCTGCTCTGTATCCAATGCTATTTAACAAATTGAAGAATACCATCAG

CAAGTTTTTTGACTCCCAAGGACAGGTTTTATTGACTGATACCAATACTCAATTTGTA

GAACAAACCATAGCTATAATGAAGAACTTGCTAGATAATCATACTGAAGGCAGCTCT

GAACATCTAGGGCAAGCTAGCATTGAAACAATGATGTTAAATCTGGCAGGTATGTTC

GTGTGCTTGGGAATATGGTCCATGCAATTCAAATAAAAACGAAACTGTGTCAATTAG

TTGAAGTAATGATGGCAAGGAGAGATGACCTCTCATTTTGCCAAGAGATGAAATTTA

GGAATAAGATGGTAGAATACCTGACAGACTGGGTTATGGGAACATCAAACCAAGCA

GCAGATGATGATGTAAAATGTCTTACAAGAGATTTGGACCAGGCAAGCATGGAAGC

AGTAGTTTCACTTCTAGCTGGTCTCCCTCTGCAGCCTGAAGAAGGAGATGGTGTGG

AATTGATGGAAGCCAAATCACAGTTATTTCTTAAATACTTCACATTATTTATGAACCT

TTTGAATGACTGCAGTGAAGTTGAAGATGAAAGTGCGCAAACAGGTGGCAGGAAAC

GTGGCATGTCTCGGAGGCTGGCATCACTGAGGCACTGTACGGTCCTTGCAATGTC

AAACTTACTCAATGCCAACGTAGACAGTGGTCTCATGCACTCCATAGGCTTAGGTTA

CCACAAGGATCTCCAGACAAGAGCTACATTTATGGAAGTTCTGACAAAAATCCTTCA

ACAAGGCACAGAATTTGACACACTTGCAGAAACAGTATTGGCTGATCGGTTTGAGA

GATTGGTGGAACTGGTCACAATGATGGGTGATCAAGGAGAACTCCCTATAGCGATG

GCTCTGGCCAATGTGGTTCCTTGTTCTCAGTGGGATGAACTAGCTCGAGTTCTGGT

TACTCTGTTTGATTCTCGGCATTTACTCTACCAACTGCTCTGGAACATGTTTTCTAAA

GAAGTAGAATTGGCAGACTCCATGCAGACTCTCTTCCGAGGCAACAGCTTGGCCAG

TAAAATAATGACATTCTGTTTCAAGGTATATGGTGCTACCTATCTACAAAAACTCCTG

GATCCTTTATTACGAATTGTGATCACATCCTCTGATTGGCAACATGTTAGCTTTGAA

GTGGATCCTACCAGGTTAGAACCATCAGAGAGCCTTGAGGAAAACCAGCGGAACC

TCCTTCAGATGACTGAAAAGTTCTTCCATGCCATCATCAGTTCCTCCTCAGAATTCC

-continued

CCCCTCAACTTCGAAGTGTGTGCCACTGTTTATACCAGGTGGTTAGCCAGCGTTTC

CCTCAGAACAGCATCGGTGCAGTAGGAAGTGCCATGTTCCTCAGATTTATCAATCC

TGCCATTGTCTCACCGTATGAAGCAGGGATTTTAGATAAAAAGCCACCACCTAGAAT

CGAAAGGGGCTTGAAGTTAATGTCAAAGATACTTCAGAGTATTGCCAATCATGTTCT

CTTCACAAAAGAAGAACATATGCGGCCTTTCAATGATTTTGTGAAAAGCAACTTTGA

TGCAGCACGCAGGTTTTTCCTTGATATAGCATCTGATTGTCCTACAAGTGATGCAGT

AAATCATAGTCTTTCCTTCATAAGTGACGGCAATGTGCTTGCTTTACATCGTCTACT

CTGGAACAATCAGGAGAAAATTGGGCAGTATCTTTCCAGCAACAGGGATCATAAAG

CTGTTGGAAGACGACCTTTTGATAAGATGGCAACACTTCTTGCATACCTGGGTCCT

CCAGAGCACAAACCTGTGGCAGATACACACTGGTCCAGCCTTAACCTTACCAGTTC

AAAGTTTGAGGAATTTATGACTAGGCATCAGGTACATGAAAAAGAAGAATTCAAGGC

TTTGAAAACGTTAAGTATTTTCTACCAAGCTGGGACTTCCAAAGCTGGGAATCCTAT

TTTTTATTATGTTGCACGGAGGTTCAAAACTGGTCAAATCAATGGTGATTTGCTGAT

ATACCATGTCTTACTGACTTTAAAGCCATATTATGCAAAGCCATATGAAATTGTAGTG

GACCTTACCCATACCGGGCCTAGCAATCGCTTTAAAACAGACTTTCTCTCTAAGTGG

TTTGTTGTTTTTCCTGGCTTTGCTTACGACAACGTCTCCGCAGTCTATATCTATAACT

GTAACTCCTGGGTCAGGGAGTACACCAAGTATCATGAGCGGCTGCTGACTGGCCT

CAAAGGTAGCAAAAGGCTTGTTTTCATAGACTGTCCTGGGAAACTGGCTGAGCACA

TAGAGCATGAACAACAGAAACTACCTGCTGCCACCTTGGCTTTAGAAGAGGACCTG

AAGGTATTCCACAATGCTCTCAAGCTAGCTCACAAAGACACCAAAGTTTCTATTAAA

GTTGGTTCTACTGCTGTCCAAGTAACTTCAGCAGAGCGAACAAAAGTCCTAGGGCA

ATCAGTCTTTCTAAATGACATTTATTATGCTTCGGAAATTGAAGAAATCTGCCTAGTA

GATGAGAACCAGTTCACCTTAACCATTGCAAACCAGGGCACGCCGCTCACCTTCAT

GCACCAGGAGTGTGAAGCCATTGTCCAGTCTATCATTCATATCCGGACCCGCTGGG

AACTGTCACAGCCCGACTCTATCCCCCAACACACCAAGATTCGGCCAAAAGATGTC

CCTGGGACACTGCTCAATATCGCATTACTTAATTTAGGCAGTTCTGACCCGAGTTTA

CGGTCAGCTGCCTATAATCTTCTGTGTGCCTTAACTTGTACCTTTAATTTAAAAATCG

AGGGCCAGTTACTAGAGACATCAGGTTTATGTATCCCTGCCAACAACACCCTCTTTA

TTGTCTCTATTAGTAAGACACTGGCAGCCAATGAGCCACACCTCACGTTAGAATTTT

TGGAAGAGTGTATTTCTGGATTTAGCAAATCTAGTATTGAATTGAAACACCTTTGTTT

GGAATACATGACTCCATGGCTGTCAAATCTAGTTCGTTTTTGCAAGCATAATGATGA

TGCCAAACGACAAAGAGTTACTGCTATTCTTGACAAGCTGATAACAATGACCATCAA

TGAAAAACAGATGTACCCATCTATTCAAGCAAAAATATGGGGAAGCCTTGGGCAGA

TTACAGATCTGCTTGATGTTGTACTAGACAGTTTCATCAAAACCAGTGCAACAGGTG

GCTTGGGATCAATAAAAGCTGAGGTGATGGCAGATACTGCTGTAGCTTTGGCTTCT

GGAAATGTGAAATTGGTTTCAAGCAAGGTTATTGGAAGGATGTGCAAAATAATTGAC

AAGACATGCTTATCTCCAACTCCTACTTTAGAACAACATCTTATGTGGGATGATATT

GCTATTTTAGCACGCTACATGCTGATGCTGTCCTTCAACAATTCCCTTGATGTGGCA

GCTCATCTTCCCTACCTCTTCCACGTTGTTACTTTCTTAGTAGCCACAGGTCCGCTC

TCCCTTAGAGCTTCCACACATGGACTGGTCATTAATATCATTCACTCTCTGTGTACT

TGTTCACAGCTTCATTTTAGTGAAGAGACCAAGCAAGTTTTGAGACTCAGTCTGACA

-continued

GAGTTCTCATTACCCAAATTTTACTTGCTGTTTGGCATTAGCAAAGTCAAGTCAGCT

GCTGTCATTGCCTTCCGTTCCAGTTACCGGGACAGGTCATTCTCTCCTGGCTCCTA

TGAGAGAGAGACTTTTGCTTTGACATCCTTGGAAACAGTCACAGAAGCTTTGTTGGA

GATCATGGAGGCATGCATGAGAGATATTCCAACGTGCAAGTGGCTGGACCAGTGG

ACAGAACTAGCTCAAAGATTTGCATTCCAATATAATCCATCCCTGCAACCAAGAGCT

CTTGTTGTCTTTGGGTGTATTAGCAAACGAGTGTCTCATGGGCAGATAAAGCAGATA

ATCCGTATTCTTAGCAAGGCACTTGAGAGTTGCTTAAAAGGACCTGACACTTACAAC

AGTCAAGTTCTGATAGAAGCTACAGTAATAGCACTAACCAAATTACAGCCACTTCTT

AATAAGGACTCGCCTCTGCACAAAGCCCTCTTTTGGGTAGCTGTGGCTGTGCTGCA

GCTTGATGAGGTCAACTTGTATTCAGCAGGTACCGCACTTCTTGAACAAAACCTGC

ATACTTTAGATAGTCTCCGTATATTCAATGACAAGAGTCCAGAGGAAGTATTTATGG

CAATCCGGAATCCTCTGGAGTGGCACTGCAAGCAAATGGATCATTTTGTTGGACTC

AATTTCAACTCTAACTTTAACTTTGCATTGGTTGGACACCTTTTAAAAGGGTACAGG

CATCCTTCACCTGCTATTGTTGCAAGAACAGTCAGAATTTTACATACACTACTAACTC

TGGTTAACAAACACAGAAATTGTGACAAATTTGAAGTGAATACACAGAGCGTGGCCT

ACTTAGCAGCTTTACTTACAGTGTCTGAAGAAGTTCGAAGTCGCTGCAGCCTAAAAC

ATAGAAAGTCACTTCTTCTTACTGATATTTCAATGGAAAATGTTCCTATGGATACATA

TCCCATTCATCATGGTGACCCTTCCTATAGGACACTAAAGGAGACTCAGCCATGGT

CCTCTCCCAAAGGTTCTGAAGGATACCTTGCAGCCACCTATCCAACTGTCGGCCAG

ACCAGTCCCCGAGCCAGGAAATCCATGAGCCTGGACATGGGGCAACCTTCTCAGG

CCAACACTAAGAAGTTGCTTGGAACAAGGAAAAGTTTTGATCACTTGATATCAGACA

CAAAGGCTCCTAAAAGGCAAGAAATGGAATCAGGGATCACAACACCCCCCCAAAATG

AGGAGAGTAGCAGAAACTGATTATGAAATGGAAACTCAGAGGATTTCCTCATCACA

ACAGCACCCACATTTACGTAAAGTTTCAGTGTCTGAATCAAATGTTCTCTTGGATGA

AGAAGTACTTACTGATCCGAAGATCCAGGCGCTGCTTCTTACTGTTCTAGCTACACT

GGTAAAATATACCACAGATGAGTTTGATCAACGAATTCTTTATGAATACTTAGCAGA

GGCCAGTGTTGTGTTTCCCAAAGTCTTTCCTGTTGTGCATAATTTGTTGGACTCTAA

GATCAACACCCTGTTATCATTGTGCCAAGATCCAAATTTGTTAAATCCAATCCATGG

AATTGTGCAGAGTGTGGTGTACCATGAAGAATCCCCACCACAATACCAAACATCTTA

CCTGCAAAGTTTTGGTTTTAATGGCTTGTGGCGGTTTGCAGGACCGTTTTCAAAGCA

AACACAAATTCCAGACTATGCTGAGCTTATTGTTAAGTTTCTTGATGCCTTGATTGAC

ACGTACCTGCCTGGAATTGATGAAGAAACCAGTGAAGAATCCCTCCTGACTCCCAC

ATCTCCTTACCCTCCTGCACTGCAGAGCCAGCTTAGTATCACTGCCAACCTTAACCT

TTCTAATTCCATGACCTCACTTGCAACTTCCCAGCATTCCCCAGGAATCGACAAGGA

GAACGTTGAACTCTCCCCTACCACTGGCCACTGTAACAGTGGACGAACTCGCCACG

GATCCGCAAGCCAAGTGCAGAAGCAAAGAAGCGCTGGCAGTTTCAAACGTAATAG

CATTAAGAAGATCGTGTGAAGCTTGCTTGCTTTCTTTTTTAAAATCAACTTAACATGG

GCTCTTCACTAGTGACCCCTTCCCTGTCCTTGCCCTTTCCCCCCATGTTGTAATGCT

GCACTTCCTGTTTTATAATGAACCCATCCGGTTTGCCATGTTGCCAGATGATCAACT

CTTCGAAGCCTTGCCTAAATTTAATGCTGCCTTTTCTTTAACTTTTTTTCTTCTACTTT

-continued

TGGCGTGTATCTGGTATATGTAAGTGTTCAGAACAACTGCAAAGAAAGTGGGAGGT

CAGGAAACTTTTAACTGAGAAATCTCAATTGTAAGAGAGGATGAATTCTTGAATACT

GCTACTACTGGCCAGTGATGAAAGCCATTTGCACAGAGCTCTGCCTTCTGTGGTTT

TCCCTTCTTCATCCTACAGAGTAAAGTGTTAGTCCTATTTATACATTTTTCAAGATAC

AAGTTTATGAGAGAAATAGTATTATAACCCCAGTATGTTTAATCTTTTAGCTGTGGAC

TTTTTTTTTAACCGTACAAAACTGAAAGAACCATAGAGGTCAAGCCTCAGTGACTTG

ACACCATAAAGCCACAGACAAGGTACTTGGGGGGGAGGGCAGGGAAATTTCATATT

TTATAGTGGATTCTTAAGAAATACTAACACTTGAGTATTAGCAATAATTACAGGAAAA

TAAGTGCGACCACATATATCTTAACATTACTGAATTAAAACTATGGCTTCTAAGTCCT

TATCCAAACTCAGTCATCCAAACTAGTTTATTTTTTTCTCCAGTTGATTATCTTTTAAT

TTTTAATTTTGCTAAAGGTGGTTTTTTTGTGTTTTGTTTTTTGTAAACCAAAACTATAC

TAAGTATAGTAATTATATATATATATATATTTTTTCCCCTCCCCCTCTTCTTTCCTAAC

TAATTCTGAGCAGGGTAATCAGTGAACAAAGTGTTGAAAATTGTTCCCAGAAGGTAA

TTTTCATAGATGTTTGCATTAGCTCCATAGCAAAATGGAATGGTACGTGACATTTAG

GGTAGCTGATATTTTTATTTTGTTAAATAATTTCCAAGAATAGAGTATGGTGTATATT

ATAAATTTCTTTGATAAGATGTATTTTGAATGTCTTTTAATCTTCCTCCTCCTCTCCAA

AAAAATCAGAAACCTCTTTAAGAAAACATGTAGGTTATATATGCTAGAATTGCATTTA

ATCACTGTGAAAAGACTGGTCAGCCTGCATTAGTATGACAGTAGGGGGGCTGTTAG

AATTGCTGCTATACTGGTGGTATGGATTATCATGGCATTGGAATTTTCATAGTAATG

CAGATCCAATTTCTTTGTGGTACCTGCAGTTTACAAAATAATTTGACTTCAGTGAGC

ATATTGGTATCTGGATGTTCCAATTTAGAACTAAACCATATTTATTACAAAAAGATAT

TAATCCCTCTACTCCCAGGTTCCCTTTATATGTTAAGATATAATGGCTTTGAGGGGG

GAAAAAATAAACCTAGGGGAGAGGGGAGTTTCCTGTAGTGCTGTTTCATTAGAGGA

TTTCAGTAAATTAAATTCCACAGCTAATTCAATAAATAATGGTACATTTAAGTGTTCT

GATTTTAATAATATATTTCACATTTATCCACACAGTAACAATGTAATATGTTAATGTAA

ATAAAATTGGTTTTGATACTCAGAAATAACAAGAATTTAATTTTTTAAATTTGTTTACA

GTCCTGGGAAAAGTAAGAATTATTTGCCAAAATAAGAGGAAAGAAAACCTTAGTATT

ATTAATGAGTTTACCATAGAATTGTTGGAAATACTGAAGACAGGTGCAATTTACTAAA

CTTTTGTTTTTAAACTATTGTAGAGGCTGCATTAGAAGAAAATGTTTATAATGACAGA

GCAACTATGACTATATAAAAAAGCTGAAATTAGAACTGTGTTTAGAAATAGATCAGTA

ACCCAGTGCCAAGGATGCCAAGCTGCCACCATGGTCTTGGCTCTCCCACAACCCA

GTGTTTCTGGGGTAAGTTTCACAGTTTCTAGGCCCTGGAATAGCAGGCAGTGTAAG

CCTTTGATAACTTTAGTTCGATGTTTTTCTTGTTTTTGTTTGTTGGTTTGGTGCATATG

ATAGTGGGTGTTATGCTATTTTGCTCTTCCCATCAAAATAAAGAAACTTCCAGAGGT

TTACTGTTAAAAATACTGATATTTCCATAAACGGGTTTACCAAGGGTGTAGTATTTCA

TACCGCCTGAAATGATCAGCATTGGCACAAATCAAAATTCAGCCGCCTTTGAAATGC

AAAAATACCTTTGACTAGTAAGTACATCCTAGGAGTTTGAAAACTTAACTAAGGTTTA

AAATTTACCTTGTTTAAAGAACTTCTGACTTTTGAGGAAAATCTAGCTTTCCAAGTAA

CTAAAATGTACATGAGATAAACCTCTCACCACTATGTGTCCCTTGAGAAATGCAACA

CTTTTTTAGTCTTCATACTTGTAATCTATAAAAGAAATTCTGAAGTTTAGACCAAGTT

GCCCATTTCTGCGTAATTGACATAAGTTCTGTTAAAAATATTATAAGTAATTCGTTTC

-continued

GGTTTGTAGATGTTTCCCCTGACTTGTTAAAGAGGAAACCAGGAACTCAGTCATGTT
TTTGTCCTGGATAATCTACCTGTTATGCCAGTACTCCCATCCGAGGGGCATGCCCT
TAGTTGCCCAGATGGAGATGCAGTTCAGTAGATTTGGGGCAAAGTGGCTACAGCTC
TGTCTTCCATTCACTCAACACCTGTTCATGACTGAGCCAGGTGCCCAGGACACATC
CTAAACAGTCAGCTTCTATCCTGTGTCCTAGTTGGGGAGACAGAGTGCCAGCCAGC
AACCCTCCCAGGTTTGTAGGTTTTAGGGGTTTTCAGTTTTGTTTGGGTTTTTTGTTTT
TTGTTTTTGTTTCTACATCCTTCCCCGACTCCCAGGCATAATGAGGCATGTCTTACT
CAATGTTATGCAATGGATTTAGGCAAAAATTCATTCTTAGTGTCAGCCACACAATTTT
TTTTAATGCAGTATATTCACCTGTAAATAGTTTGTGTAAAATTTGACAAAAAAAGTAT
ATTTACTATACTGTAAATATATGTGATGATATATTGTATTATTTTGCTTTTTTGTAAAG
CAGTTAGTTGCTGCACATGGATAACAACAAAAATTTGATTATTCTCGTGTTAGTATTG
TTAACTTCTTTTTGCGACTGCGTTACATCATTTAAAGAAAATGCTGTGTATTGTAAAC
TTAAATTGTATATGATAACTTACTGTCCTTTCCATCCGGGCCTAAACTTTGGCAGTTC
CTTTGTCTACAACCTTGTTAATACTGTAAACAGTTGTACGCCAGCAGGAAAAATACT
GCCCAACAGACAAAATCGATCATTGTAGGGGAAAATCATAGAAATCCATTTCAGATC
TTTATTGTTCCTCACCCCATTTTCCTCCTTGTGTATGTACTTCCCCCACCCCCCTTTT
TTTAAGTAAAATGTAAATTCAATCTGCTCTAAGAAAAAAAAAAAAAAAAAAAA., or a nucleic acid sequence that hybridizes to a nucleic acid sequence consisting of SEQ ID NO:268 under stringent hybridization conditions In some embodiments, early growth response 1 (EGR1, TIS8, AT225, KROX-24, NGFI-A, ZNF225) comprises the amino acid sequence:

(SEQ ID NO: 269; NP_001955.1)
MAAAKAEMQLMSPLQISDPFGSFPHSPTMDNYPKLEEMMLLSNGAPQFLG
AAGAPEGSGSNSSSSSSGGGGGGGGGSNSSSSSSTFNPQADTGEQPYEHL
TAESFPDISLNNEKVLVETSYPSQTTRLPPITYTGRFSLEPAPNSGNTLW
PEPLFSLVSGLVSMTNPPASSSSAPSPAASSASASQSPPLSCAVPSNDSS
PIYSAAPTFPTPNTDIFPEPQSQAFPGSAGTALQYPPPAYPAAKGGFQVP
MIPDYLFPQQQGDLGLGTPDQKPFQGLESRTQQPSLTPLSTIKAFATQSG
SQDLKALNTSYQSQLIKPSRMRKYPNRPSKTPPHERPYACPVESCDRRFS
RSDELTRHIRIHTGQKPFQCRICMRNFSRSDHLTTHIRTHTGEKPFACDI
CGRKFARSDERKRHTKIHLRQKDKKADKSVVASSATSSLSSYPSPVATSY
PSPVTTSYPSPATTSYPSPVPTSFSSPGSSTYPSPVHSGFPSPSVATTYS
SVPPAFPAQVSSFPSSAVTNSFSASTGLSDMTATFSPRTIEIC, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:269)

In some embodiments, the nucleic acid sequence encoding Fos comprises the nucleic acid sequence:

(SEQ ID NO: 270; NM_001964.3)
GAGAGATCCCAGCGCGCAGAACTTGGGGAGCCGCCGCCGCCATCCGCCGC
CGCAGCCAGCTTCCGCCGCCGCAGGACCGGCCCCTGCCCCAGCCTCCGCA
GCCGCGGCGCGTCCACGCCCGCCCGCGCCCAGGGCGAGTCGGGGTCGCCG
CCTGCACGCTTCTCAGTGTTCCCCGCGCCCCGCATGTAACCCGGCCAGGC
CCCCGCAACTGTGTCCCCTGCAGCTCCAGCCCCGGGCTGCACCCCCCCGC
CCCGACACCAGCTCTCCAGCCTGCTCGTCCAGGATGGCCGCGGCCAAGGC
CGAGATGCAGCTGATGTCCCCGCTGCAGATCTCTGACCCGTTCGGATCCT
TTCCTCACTCGCCCACCATGGACAACTACCCTAAGCTGGAGGAGATGATG
CTGCTGAGCAACGGGGCTCCCCAGTTCCTCGGCGCCGCCGGGGCCCCAGA
GGGCAGCGGCAGCAACAGCAGCAGCAGCAGCAGCGGGGGCGGTGGAGGCG
GCGGGGGCGGCAGCAACAGCAGCAGCAGCAGCAGCACCTTCAACCCTCAG
GCGGACACGGGCGAGCAGCCCTACGAGCACCTGACCGCAGAGTCTTTTCC
TGACATCTCTCTGAACAACGAGAAGGTGCTGGTGGAGACCAGTTACCCCA
GCCAAACCACTCGACTGCCCCCCATCACCTATACTGGCCGCTTTTCCCTG
GAGCCTGCACCCAACAGTGGCAACACCTTGTGGCCCGAGCCCCTCTTCAG
CTTGGTCAGTGGCCTAGTGAGCATGACCAACCCACCGGCCTCCTCGTCCT
CAGCACCATCTCCAGCGGCCTCCTCCGCCTCCGCCTCCCAGAGCCCACCC
CTGAGCTGCGCAGTGCCATCCAACGACAGCAGTCCCATTTACTCAGCGGC
ACCCACCTTCCCCACGCCGAACACTGACATTTTCCCTGAGCCACAAAGCC
AGGCCTTCCCGGGCTCGGCAGGGACAGCGCTCCAGTACCCGCCTCCTGCC

-continued

TACCCTGCCGCCAAGGGTGGCTTCCAGGTTCCCATGATCCCCGACTACCT

GTTTCCACAGCAGCAGGGGGATCTGGGCCTGGGCACCCCAGACCAGAAGC

CCTTCCAGGGCCTGGAGAGCCGCACCCAGCAGCCTTCGCTAACCCCTCTG

TCTACTATTAAGGCCTTTGCCACTCAGTCGGGCTCCCAGGACCTGAAGGC

CCTCAATACCAGCTACCAGTCCCAGCTCATCAAACCCAGCCGCATGCGCA

AGTACCCCAACCGGCCCAGCAAGACGCCCCCCCACGAACGCCCTTACGCT

TGCCCAGTGGAGTCCTGTGATCGCCGCTTCTCCCGCTCCGACGAGCTCAC

CCGCCACATCCGCATCCACACAGGCCAGAAGCCCTTCCAGTGCCGCATCT

GCATGCGCAACTTCAGCCGCAGCGACCACCTCACCACCCACATCCGCACC

CACACAGGCGAAAAGCCCTTCGCCTGCGACATCTGTGGAAGAAAGTTTGC

CAGGAGCGATGAACGCAAGAGGCATACCAAGATCCACTTGCGGCAGAAGG

ACAAGAAAGCAGACAAAAGTGTTGTGGCCTCTTCGGCCACCTCCTCTCTC

TCTTCCTACCCGTCCCCGGTTGCTACCTCTTACCCGTCCCCGGTTACTAC

CTCTTATCCATCCCCGGCCACCACCTCATACCCATCCCCTGTGCCCACCT

CCTTCTCCTCTCCCGGCTCCTCGACCTACCCATCCCCTGTGCACAGTGGC

TTCCCCTCCCCGTCGGTGGCCACCACGTACTCCTCTGTTCCCCCTGCTTT

CCCGGCCCAGGTCAGCAGCTTCCCTTCCTCAGCTGTCACCAACTCCTTCA

GCGCCTCCACAGGGCTTTCGGACATGACAGCAACCTTTTCTCCCAGGACA

ATTGAAATTTGCTAAAGGGAAAGGGGAAAGAAAGGGAAAAGGGAGAAAAA

GAAACACAAGAGACTTAAAGGACAGGAGGAGGAGATGGCCATAGGAGAGG

AGGGTTCCTCTTAGGTCAGATGGAGGTTCTCAGAGCCAAGTCCTCCCTCT

CTACTGGAGTGGAAGGTCTATTGGCCAACAATCCTTTCTGCCCACTTCCC

CTTCCCCAATTACTATTCCCTTTGACTTCAGCTGCCTGAAACAGCCATGT

CCAAGTTCTTCACCTCTATCCAAAGAACTTGATTTGCATGGATTTTGGAT

AAATCATTTCAGTATCATCTCCATCATATGCCTGACCCCTTGCTCCCTTC

AATGCTAGAAAATCGAGTTGGCAAAATGGGGTTTGGGCCCCTCAGAGCCC

TGCCCTGCACCCTTGTACAGTGTCTGTGCCATGGATTTCGTTTTTCTTGG

GGTACTCTTGATGTGAAGATAATTTGCATATTCTATTGTATTATTTGGAG

TTAGGTCCTCACTTGGGGGAAAAAAAAAAAAAGAAAAGCCAAGCAAACCAA

TGGTGATCCTCTATTTTGTGATGATGCTGTGACAATAAGTTTGAACCTTT

TTTTTTGAAACAGCAGTCCCAGTATTCTCAGAGCATGTGTCAGAGTGTTG

TTCCGTTAACCTTTTTGTAAATACTGCTTGACCGTACTCTCACATGTGGC

AAAATATGGTTTGGTTTTTCTTTTTTTTTTTTTTTGAAAGTGTTTTTTCT

TCGTCCTTTTGGTTTAAAAAGTTTCACGTCTTGGTGCCTTTTGTGTGATG

CGCCTTGCTGATGGCTTGACATGTGCAATTGTGAGGGACATGCTCACCTC

TAGCCTTAAGGGGGGCAGGGAGTGATGATTTGGGGGAGGCTTTGGGAGCA

AAATAAGGAAGAGGGCTGAGCTGAGCTTCGGTTCTCCAGAATGTAAGAAA

ACAAAATCTAAAACAAAATCTGAACTCTCAAAAGTCTATTTTTTTAACTG

AAAATGTAAATTTATAAATATATTCAGGAGTTGGAATGTTGTAGTTACCT

ACTGAGTAGGCGGCGATTTTTGTATGTTATGAACATGCAGTTCATTATTT

-continued

TGTGGTTCTATTTTACTTTGTACTTGTGTTTGCTTAAACAAAGTGACTGT

TTGGCTTATAAACACATTGAATGCGCTTTATTGCCCATGGGATATGTGGT

GTATATCCTTCCAAAAAATTAAAACGAAAATAAAGTA, or a nucleic acid sequence that hybridizes to a nucleic acid sequence consisting of SEQ ID NO:270 under stringent hybridization conditions In some embodiments, early growth response 2 (EGR2, CHN1, AT591, CMT1D, CMT4E, KROX20) comprises the amino acid sequence:

(SEQ ID NO: 271; NP_000390.2)

MMTAKAVDKIPVTLSGFVHQLSDNIYPVEDLAATSVTIFPNAELGGPFDQ

MNGVAGDGMINIDMTGEKRSLDLPYPSSFAPVSAPRNQTFTYMGKFSIDP

QYPGASCYPEGIINIVSAGILQGVTSPASTTASSSVTSASPNPLATGPLG

VCTMSQTQPDLDHLYSPPPPPPPYSGCAGDLYQDPSAFLSAATTSTSSSL

AYPPPPSYPSPKPATDPGLFPMIPDYPGFFPSQCQRDLHGTAGPDRKPFP

CPLDTLRVPPPLTPLSTIRNFTLGGPSAGVTGPGASGGSEGPRLPGSSSA

AAAAAAAAYNPHHLPLRPILRPRKYPNRPSKTPVHERPYPCPAEGCDRR

FSRSDELTRHIRIHTGHKPFQCRICMRNFSRSDHLTTHIRTHTGEKPFAC

DYCGRKFARSDERKRHTKIHLRQKERKSSAPSASVPAPSTASCSGGVQPG

GTLCSSNSSSLGGGPLAPCSSRTRTP, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:271)

In some embodiments, the nucleic acid sequence encoding EGR2 comprises the nucleic acid sequence:

(SEQ ID NO: 272; NM_000399.5)

AACTGAGCGAGGAGCAATTGATTAATAGCTCGGCGAGGGGACTCACTGA

CTGTTATAATAACACTACACCAGCAACTCCTGGCTTCCCAGCAGCCGGA

ACACAGACAGGAGAGAGTCAGTGGCAAATAGACATTTTTCTTATTTCTT

AAAAAACAGCAACTTGTTTGCTACTTTTATTTCTGTTGATTTTTTTTTC

TTGGTGTGTGTGGTGGTTGTTTTTAAGTGTGGAGGGCAAAAGGAGATAC

CATCCCAGGCTCAGTCCAACCCCTCTCCAAAACGGCTTTTCTGACACTC

CAGGTAGCGAGGGAGTTGGGTCTCCAGGTTGTGCGAGGAGCAAATGATG

ACCGCCAAGGCCGTAGACAAAATCCCAGTAACTCTCAGTGGTTTTGTGC

ACCAGCTGTCTGACAACATCTACCCGGTGGAGGACCTCGCCGCCACGTC

GGTGACCATCTTTCCCAATGCCGAACTGGGAGGCCCCTTTGACCAGATG

AACGGAGTGGCCGGAGATGGCATGATCAACATTGACATGACTGGAGAGA

AGAGGTCGTTGGATCTCCCATATCCCAGCAGCTTTGCTCCCGTCTCTGC

ACCTAGAAACCAGACCTTCACTTACATGGGCAAGTTCTCCATTGACCCT

CAGTACCCTGGTGCCAGCTGCTACCCAGAAGGCATAATCAATATTGTGA

GTGCAGGCATCTTGCAAGGGGTCACTTCCCCAGCTTCAACCACAGCCTC

ATCCAGCGTCACCTCTGCCTCCCCCAACCCACTGGCCACAGGACCCCTG

-continued

GGTGTGTGCACCATGTCCCAGACCCAGCCTGACCTGGACCACCTGTACT

CTCCGCCACCGCCTCCTCCTCCTTATTCTGGCTGTGCAGGAGACCTCTA

CCAGGACCCTTCTGCGTTCCTGTCAGCAGCCACCACCTCCACCTCTTCC

TCTCTGGCCTACCCACCACCTCCTTCCTATCCATCCCCCAAGCCAGCCA

CGGACCCAGGTCTCTTCCCAATGATCCCAGACTATCCTGGATTCTTTCC

ATCTCAGTGCCAGAGAGACCTACATGGTACAGCTGGCCCAGACCGTAAG

CCCTTTCCCTGCCCACTGGACACCCTGCGGGTGCCCCCTCCACTCACTC

CACTCTCTACAATCCGTAACTTTACCCTGGGGGGCCCCAGTGCTGGGGT

GACCGGACCAGGGGCCAGTGGAGGCAGCGAGGGACCCCGGCTGCCTGGT

AGCAGCTCAGCAGCAGCAGCAGCCGCCGCCGCCGCCGCCTATAACCCAC

ACCACCTGCCACTGCGGCCCATTCTGAGGCCTCGCAAGTACCCCAACAG

ACCCAGCAAGACGCCGGTGCACGAGAGGCCCTACCCGTGCCCAGCAGAA

GGCTGCGACCGGCGGTTCTCCCGCTCTGACGAGCTGACACGGCACATCC

GAATCCACACTGGGCATAAGCCCTTCCAGTGTCGGATCTGCATGCGCAA

CTTCAGCCGCAGTGACCACCTCACCACCCATATCCGCACCCACACCGGT

GAGAAGCCCTTCGCCTGTGACTACTGTGGCCGAAAGTTTGCCCGGAGTG

ATGAGAGGAAGCGCCACACCAAGATCCACCTGAGACAGAAAGAGCGGAA

AAGCAGTGCCCCCTCTGCATCGGTGCCAGCCCCCTCTACAGCCTCCTGC

TCTGGGGGCGTGCAGCCTGGGGGTACCCTGTGCAGCAGTAACAGCAGCA

GTCTTGGCGGAGGGCCGCTCGCCCCTTGCTCCTCTCGGACCCGGACACC

TTGAGATGAGACTCAGGCTGATACACCAGCTCCCAAAGGTCCCGGAGGC

CCTTTGTCCACTGGAGCTGCACAACAAACACTACCACCCTTTCCTGTCC

CTCTCTCCCTTTGTTGGGCAAAGGGCTTTGGTGGAGCTAGCACTGCCCC

CTTTCCACCTAGAAGCAGGTTCTTCCTAAAACTTAGCCCATTCTAGTCT

CTCTTAGGTGAGTTGACTATCAACCCAAGGCAAAGGGGAGGCTCAGAAG

GAGGTGGTGTGGGGACCCCTGGCCAAGAGGGCTGAGGTCTGACCCTGCT

TTAAAGGGTTGTTTGACTAGGTTTTGCTACCCCACTTCCCCTTATTTTG

ACCCATCACAGGTTTTTGACCCTGGATGTCAGAGTTGATCTAAGACGTT

TTCTACAATAGGTTGGGAGATGCTGATCCCTTCAAGTGGGGACAGCAAA

AAGACAAGCAAAACTGATGTGCACTTTATGGCTTGGGACTGATTTGGGG

GACATTGTACAGTGAGTGAAGTATAGCCTTTATGCCACACTCTGTGGCC

CTAAAATGGTGAATCAGAGCATATCTAGTTGTCTCAACCCTTGAAGCAA

TATGTATTATAAACTCAGAGAACAGAAGTGCAATGTGATGGGAGGAACA

TAGCAATATCTGCTCCTTTTCGAGTTGTTTGAGAAATGTAGGCTATTTT

TTCAGTGTATATCCACTCAGATTTTGTGTATTTTTGATGTACACTGTTC

TCTAAATTCTGAATCTTTGGGAAAAAATGTAAAGCATTTATGATCTCAG

AGGTTAACTTATTTAAGGGGGATGTACATATATTCTCTGAAACTAGGAT

GCATGCAATTGTGTTGGAAGTGTCCTTGGTGCCTTGTGTGATGTAGACA

ATGTTACAAGGTCTGCATGTAAATGGGTTGCCTTATTATGGAGAAAAAA

AATCACTCCCTGAGTTTAGTATGGCTGTATATTTCTGCCTATTAATATT

TGGAATTTTTTTTAGAAAGTATATTTTTGTATGCTTTGTTTTGTGACTT

-continued

AAAAGTGTTACCTTTGTAGTCAAATTTCAGATAAGAATGTACATAATGT

TACCGGAGCTGATTTGTTTGGTCATTAGCTCTTAATAGTTGTGAAAAAA

TAAATCTATTCTAACGCAAAACCACTAACTGAAGTTCAGATAATGGATG

GTTTGTGACTATAGTGTAAATAAATACTTTTCAACAATA, or a nucleic acid sequence that hybridizes to a nucleic acid sequence consisting of SEQ ID NO:272 under stringent hybridization conditions In some embodiments, Sp3 transcription factor (SP3, SPR2) comprises the amino acid sequence:

(SEQ ID NO: 273; NP_001017371.3)

MGPPSPGDDEEEAAAAAGAPAAAGATGDLASAQLGGAPNRWEVLSATPT

TIKDEAGNLVQIPSAATSSGQYVLPLQNLQNQQIFSVAPGSDSSNGTVS

SVQYQVIPQIQSADGQQVQIGFTGSSDNGGINQESSQIQIIPGSNQTLL

ASGTPSANIQNLIPQTGQVQVQGVAIGGSSFPGQTQVVANVPLGLPGNI

TFVPINSVDLDSLGLSGSSQTMTAGINADGHLINTGQAMDSSDNSERTG

ERVSPDINETNTDTDLFVPTSSSSQLPVTIDSTGILQQNTNSLTTSSGQ

VHSSDLQGNYIQSPVSEETQAQNIQVSTAQPVVQHLQLQESQQPTSQAQ

IVQGITPQTIHGVQASGQNISQQALQNLQLQLNPGTFLIQAQTVTPSGQ

VTWQTFQVQGVQNLQNLQIQNTAAQQITLTPVQTLTLGQVAAGGAFTST

PVSLSTGQLPNLQTVTVNSIDSAGIQLHPGENADSPADIRIKEEEPDPE

EWQLSGDSTLNTNDLTHLRVQVVDEEGDQQHQEGKRLRRVACTCPNCKE

GGGRGTNLGKKKQHICHIPGCGKVYGKTSHLRAHLRWHSGERPFVCNWM

YCGKRFTRSDELQRHRRTHTGEKKFVCPECSKRFMRSDHLAKHIKTHQN

KKGIHSSSTVLASVEAARDDTLITAGGTTLILANIQQGSVSGIGTVNTS

ATSNQDILTNTEIPLQLVTVSGNETME, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:273)

In some embodiments, the nucleic acid sequence encoding SP3 comprises the nucleic acid sequence:

(SEQ ID NO: 274; NM_001017371.5)

ACTCAGCCGTCACCGCTCGCTCTGCTGGCCGCTACCTGCAGCAAGATAG

GGCCGCCATCGCCGGGCGACGACGAGGAGGAGGCGGCCGCCGCAGCCGG

GGCCCCCGCCGCCGCCGGAGCGACAGGTGATTTGGCTTCTGCACAGTTA

GGAGGAGCACCAAACCGATGGGAGGTTTTGTCAGCCACACCTACAACTA

TAAAAGATGAAGCTGGTAATCTAGTCCAGATTCCAAGTGCTGCTACTTC

AAGTGGGCAGTATGTTCTTCCCCTTCAGAATTTGCAGAATCAACAAATA

TTTTCCGTTGCACCAGGATCAGATTCATCAAATGGTACAGTGTCCAGTG

TTCAATTCAAGTGATACCACAGATCCAGTCAGCAGATGGTCAGCAGGTT

CAAATTGGTTTCACAGGCTCTTCAGATAATGGGGGTATAAATCAAGAAA

GCAGTCAAATTCAGATCATTCCTGGCTCTAATCAAACCTTACTTGCCTC

TGGAACACCTTCTGCTAACATCCAGAATCTCATACCACAGACTGGTCAA
GTCCAGGTTCAGGGAGTTGCAATTGGTGGTTCATCTTTTCCTGGTCAAA
CCCAAGTAGTTGCTAATGTGCCTCTTGGTCTGCCAGGAAATATTACGTT
TGTACCAATCAATAGTGTCGATCTAGATTCTTTGGGACTCTCGGGCAGT
TCTCAGACAATGACTGCAGGCATTAATGCCGACGGACATTTGATAAACA
CAGGACAAGCTATGGATAGTTCAGACAATTCAGAAAGGACTGGTGAGCG
GGTTTCTCCTGATATTAATGAAACTAATACTGATACAGATTTATTTGTG
CCAACATCCTCTTCATCACAGTTGCCTGTTACGATAGATAGTACAGGTA
TATTACAACAAAACACAAATAGCTTGACTACATCTAGTGGGCAGGTTCA
TTCTTCAGATCTTCAGGGAAATTATATCCAGTCGCCTGTTTCTGAAGAG
ACACAGGCACAGAATATTCAGGTTTCTACAGCACAGCCTGTTGTACAGC
ATCTACAACTTCAAGAGTCTCAGCAGCCAACCAGTCAAGCCCAAATTGT
GCAAGGTATTACACCACAGACAATCCATGGTGTGCAAGCCAGTGGTCAA
AATATATCACAACAGGCTTTGCAAAATCTTCAGTTGCAGCTGAATCCTG
GAACCTTTTTAATTCAGGCACAGACAGTGACCCCTTCTGGACAGGTAAC
TTGGCAAACGTTTCAAGTACAAGGGGTCCAGAACTTGCAGAATTTGCAA
ATACAGAATACTGCTGCCCAACAAATAACTTTGACGCCTGTTCAAACCC
TCACACTTGGTCAAGTTGCGGCAGGTGGAGCCTTCACTTCAACTCCAGT
TAGTCTAAGCACTGGTCAGTTGCCAAATCTACAAACAGTTACAGTGAAC
TCTATAGATTCTGCTGGTATACAGCTACATCCAGGAGAGAATGCTGACA
GTCCTGCAGATATTAGGATCAAGGAAGAAGAACCTGATCCTGAAGAGTG
GCAGCTCAGTGGTGATTCTACCTTGAATACCAATGACCTAACACACTTA
AGAGTACAGGTGGTAGATGAAGAAGGGGACCAACAACATCAAGAAGGAA
AAAGACTTCGGAGGGTAGCTTGCACCTGTCCCAACTGTAAAGAAGGTGG
TGGAAGAGGTACCAATCTTGGGAAAAAGAAGCAACACATTTGTCATATA
CCAGGATGTGGTAAAGTCTATGGGAAGACCTCACATCTGAGAGCTCATC
TGCGTTGGCATTCTGGAGAACGCCCTTTTGTTTGTAACTGGATGTACTG
TGGTAAAAGATTTACTCGAAGTGATGAATTACAGAGGCACAGAAGAACA
CATACAGGTGAGAAGAAATTTGTTTGTCCAGAATGTTCAAAACGCTTTA
TGAGAAGTGACCACCTTGCCAAACATATTAAAACACACCAGAATAAAAA
AGGTATTCACTCTAGCAGTACAGTGCTGGCATCTGTGGAAGCTGCGCGA
GATGATACTTTGATTACTGCAGGAGGAACAACGCTTATCCTTGCAAATA
TTCAACAAGGTTCTGTTTCAGGGATAGGAACTGTTAATACTTCCGCCAC
CAGCAATCAAGATATCCTTACCAACACTGAAATACCTTTACAGCTTGTC
ACAGTTTCTGGAAATGAGACAATGGAGTAAATATTACACAAATACTTAT
TCATTGTGGTTATTTTTATACAGTAGTGAGAAGAATATTGTTCCTAAGT
TCTTAGATATCTTTTTATTGATGTGCAAAAATTTTTGGATTGACAGTAA
CTTGGTTATACATGACACTGAAATGCCTTACTTTGTATGATATTCCATA
GTATATTAAAAATGGTAAAATTGCATGGGTTTTGTAGGTACTTTTGGAA
TCTAGAAGAAATGAAATTTTACCAAGTTATATAAAGAGAAAATTGAATT
TAACAATGCGAATGGTAGTCTAACCAAATGCATCAATCCTGTGTGGTTT

-continued

AGTGTAAAAATGAGAACATGTTGGTATTTATCTATTGTAAGATAAAAAA
GCTGGTGGGTGAAAGAAATCATGTTATGATAAAAAATTTTGTAATTTTC
TTGATGACTGGAATTTTTATTATGCATAACTGACAAATCAAGTTTCCAA
GCAAATGTTACATAGTGTAGGCTTTACTTAGCTTATCAATTTGTCATTT
TGAAGCTAATTATTTTAATTAGGTTAACTATGTACAATATTTTAAGCAT
TACTCTTGTAAGATTTTGAAAACTACATTTTAACATGGAACTCTAGGGA
TAGTCACCTTTTAAATCCTGTTGAAAAGCCATGTTTAAGATTTAATTTG
CCAAAATAATGTCTTGTTAATATTCTTTCAATAACGAAGTTGGGCAATA
TAACCAATGTTTAAAAAAGTTTAAAATGTATAAGTTGAGGCATTTGGGT
GGTAAGAGAATGTTATAGTGAATTATCCCTTTTCTTGACTATTGGAGGA
CCAAAAAAATAAGGTGTATTGCGTCTTAGCAGTGATTTTTATCCAATCT
TGTTTCCAAAAACCATGTCTCCCAGGGCCTTAAAAGCCATCATGTAAAT
TACCAGTAAAGTGTAACATATGCAAACATAACAAAATCACTTCCATAGT
GACGATACTCCAACCATATGGATATTAGTCATAGAAGAACTAGAGGTTT
TATGATATTTTTTTAAGTCTTTTTTTTTTTTGTCTAGGTAGTCAGTCTG
CACTTAAATATCAATCATTTTCCTTTTTTGCTTCTTCCCTTAAAATTTA
TATGTATCCAGTACATTTAATTGAGAAGCGTATGTTTTTTATTATGCTG
TATTTTCTTTTTATTTTTTAATTATTGTTTATATTTTCAATTCAAAAAT
GTACAAAATAAAGTTACATTGCTGGTCTTGTAAGAGCTATACAGTTTTC
CTAAATGTATACCTGTAACTGCAGCAGTTCACCTATTTCAAAAATTTGG
AATTCTGTTCATTTGTTATTCTTAAGACCACCTCAAATTTAAAGGCTAC
CTTATTGTACGTTTAAAGTGTATTATAACAGTGTGGTAGTTAATAAAAC
ACTATTTTTTTTTCTTTTGAGTTTGTTGTATTCCTATGCATAAAAAATA
TTGCAGTGGTATGGGGTAAGAATTGGTGGTTTATTTTTCTTCAACTTGG
CTTTTTATTTTTAGATTCTTGATTTTAGACACTGAATTGTAAACAGGCA
TTTATTTGAAGAAGAGATATATAGAGACACTGGTCATTTACTAATTTTT
TACCTAGAGTAAATAAGAATGAGCTTATTAAATAAAATTTTTGAAAAAA
AGTCTTAGCCCTTAGCCCACATTGATTCATATCAGTTTTATCAGTACCA
TTTTGCAATTTTTTTGTTTTCCGTTTTAAAGCAATGCAGAATATTTTGA
TTTATCGAAAACCTGAATTTACATTAAGACTCCTGAAAATGATAAGACA
AGCGTTGGTAACCATGGCAGGAGTTACTTGAAAAAGTTGCCTTTGAATT
TGCATGTGTTTCATCATTATAAAGGCAGAGTAGGAGGAAAGAGTATTAA
TGTGATTGTGTATTGTAGATGTTTTAAAGTAAAAATCAAGTTTCTTAAC
ACATGTATACAGTGGGGGTAAAGATGTCCATTTTCTGTTTTCCAGGCCC
AGTCTGACTCTGTCTGTAATACCTGATTGCATTGGAGAACTCTAGACAC
GCATAAACATGGACAGTTTTTCTAAATGTGAGACTTAAGCCTGTGATGT
AAAATAGGAAGTTCTACTTGGAATAATATAAAGGAACCACTAGAATTTA
CAATTATTTTGAAGTTACAGGGATTAGATTTTGAATCTTAAAATCCTTT
AGGTAATTTTTAGAATTTTTAAATTAAGATTAATGTGAAGAGAATTAAG
TGAGCAGCAGGTGGTTCACTTGAGCAAACTGCCCATTAAGTCAGATTAA

-continued

ACCATTTGAATGATAGTAGAGATGTTTTAAGTAATACTGGATTTTTACA
GTAAGTTTATGGTGTACTTTGAATCGATAGGTGTCCATGCATATTTTAT
GAATTCGTGGAGAATGAATGCAATGAAGAAAGTAAGTAGTCTTGAAAAT
TATTTAAATAAAGTTGTAGATTTTTTTAGTGCCCCCTAGGAATATATTA
GTGAACTTTGGAACTTTTACCAAAGTTATGTAACCTCAGTGTAGATAAT
TTTAAATATTTCTATTTTTATATTTTAAAATGTTGAATATACTCTGGAA
ACAACATTTGAAGATTTGCTCTGATGTCAACTTTTTCTGGTTATAAAAC
CTATTAGTATTGTGTATAATTCTCAGGGTAGGTATACTCTAATAGGTGT
TTTGTCAATTGCTTTATTTTTGTAAAGGCTAGAGTTAGTGCATATTGAA
TATATTTATGTACAAATAATTCCTGTTGTAACATTTAGTGGACGCGATT
ATCTGTATACCTCAAATTTTAATTTAAGAAAGTATCACTTAAAGAGCAT
CTCATTTTCTATAGATTGAGGCTTAATTACTGAAAAGTGACTCAACCAA
AAAGCACATAACCTTTTAAAGGAGCTACACCTACCGCAGAAAGTCAGAT
GCCCTGTAAATAACTTTGGTCTTTCAAAATAGTGGCAATGCTTAAGATA
CTTAAAAATACACATACATATAAGCTGAAAGCATGTCAAGCCTATTTCA
TAGAAAATAGTTCTTAAACAGTATTGTTCATTAGAAATTGCTGGGGAGC
ATTTTAGAGATTCCATAGGCCTGGTAGCCACCTCAGCTTACTAAATCAA
CATCTCTGGAGATGGAGTGTATATGTGTTTTGAAACAGCTGCTCAAGTG
GTTCTGTTAAACACTCCTGCGTTACAATCACTTAAAATAGAGCAAGCAT
CCCCTTAGGCTCTTAATTGTAGTTTAAATTCCAGTACTGCCTACTCAGA
CCCAAAAGTTTTGTTTTATGAAAAATTTGTATTGTGTTCAATATTGTTT
GAAATTTGGGGTTGTTGCATAAATGATTATGGAATAACATTTGGTTTTA
AAATAATATAAACTGACATGTTATGCTACCTGTTACACAATTTGGTTTT
CAGTTTTAATTATATGAAGCTGGTAACAATCGTTTTTGTTGTAAAAGAA
TTATTTTTCACTAAACAGTATGTTTAAAACTGACTGCCATGAATGAGTA
CTAAGTCTTTTGTTGTCTGACAATAAGCACAAAACAAATTAATTGATAT
CTTTGGTACAAATTTGATATTTTTGTGAAATCACCTCATAATTTTATTT
AGTGTTGAAGAAACAACATTGGCCCCTTGCCTTGTTCAGACAGATTTGC
GTATAATGTAAATATATATATTAGTGGCAGAAACAAAGTACTGTAGAAA
CCTAGAAGAGGGAGAATTCTGCATGAAGTCTGGGAAACTCAGCAGAAAT
GGCGTTTGCAAAGGTACAGTGTGGTATGTTGGGTGATGGGGGACTTTGT
GAGGGACAGAGTGGAAAAATTTTTAAGAGGGGCTGCCAAATTGCAAAAG
AGAAGAATTTTTTTTGTCAGTGATTCCTAGTCTTTTTGGAATCCTACAC
CTTCTCCCCAGAAAAATTCATTCTAGTCCAGGGTTATTGTTTGTTTTT
TCCCTATATTTGACAGGGTCTGTCTCTGTCACACAGTGCAGTGGTGCAA
TCATGGCTTACTGCAGACTCCACTTACTGGTCTCAAGCAATCCTCCCCA
CTTCGGCCTCTTAAGTAGCTTGGACCACAGGTGCACACCACCATGCTCA
GTTAATTTTAATTTGTTTTGTAGAGATGGGGTCTCACTATATTGCCTAG
GCTGGTCTTGAATTCCTGGGCTCAAGTGATCCTTCCACCTCTGCCTCCC
AAAGTGTTGGGATTATAGGCGTGAGCCACCACGCTTGGCCAAATCTGGA
GTCTAAAGGGTATACAAGGTTTTTTTTTTTCCCATGTTGGCTTTTATTT

-continued

GATGTTATAAAGTCTTCATGATATGAATATATTTTTTAAAAAGGTGTCA
TGTATATTGTCATGTAACATGATTCATGCCACTTCATTGTATTAAATAC
GTTTAAGATACAGTTTTTGATGTTAAGAATGATATCCTGAGAAGGCCTA
TCTCCTTCAGTCCTTTTCCCCATTTTTCACCTTTTAACTCTTGCTTCTG
AATCTATGCTAAGCTACTTACTAGATGTGTGATATTGGTAGTTTTCTTA
CCTTAAAACCTCATTTTCATCATCCATGAAGAGGCTAACAATAGTACTC
CCTGTTGATAGGATTGTTGTATTAAAATATAAGCATTCAGCATAGTGCC
TGACTTAACGGTAGAGATTCAAATGGTAACCTCCTTCCAATGCCTTCCT
CCCCCCTTAACTCTGGAGATTCCATTTTTCTGTAGTGAAGTGTTTTAGA
ATTTTCATTGTTTGACTATGGTTCATACATTGATTTTTCCAAAATGAGA
AGAAGTCTTATTTCTAATGCAAAAATGTGAAAAGAACAGTTGGAACCTA
AAGTGATAGTGGATGAAGTGTCTGAAGTGACTGCCCTATCAGAAAAGGA
TGGAATAAGAAGAAAAGACTGAAGCACCTAAATGTGTATTTTCTTGAGG
AAATTACACCCCTGTGTAAGAGTCTATCCTATTTGAACATTTCTAAAAA
CCAGCCGAAGAATCTTCAGGTTCATTGCGACTGAAAGATAAAGTCTAGC
ACTGAAGTGGTTTTTAAGATTAGGAAAGGCCATCAGAGAAATGCAGTTA
TTTCTCCCCTCCATCCTTCCCCCACAAAAAAAAGTCTAAGCCTCCGATT
AATCGACAACAACGAAATACAGGAAGTATTGGCTTAGTGACCTTTTAGG
ATATCTGTCCGACTTACATCCCTTCTCTGAGCATTACTTTCTGCCACCT
TCCGTGAGGAGCTGTTCAGAAATCAGACAAGGAGTGGACATCTGGTCAA
AGTTGAGCCAATTAGATGATTTCTCCTGAGAATTTGGAATTGGAAAACT
GATGTCTTGGGAGGTCACATCTGGAACATACATGGAGGCAGAGAAAGC
AAAGATGACATTCAACCCCAGAAGAAAAAGAAAATGGCTTTCTTGATTC
CTGATAACTTGGCAGTGTTTGTTCCAGTGTCTTGCATTTCACTATCTGC
ATTTCATCCTCCTGGGGTTCCACAAGATAGCCTTAAAACCTTACAGAGA
GACTCCCCAACTTAGTTTTTTCTTAAGTCAGAAGGCTGTTACTTGCTAC
CAAATAATGCCAACTAAGACAACTGAGGTACAGTATATTCTCTCGTAAA
ACACCATAGAGTTGATGACTTGATCCTATAGAAAAGGGTCCCCAACCCC
TGGGCCACAGACCGGTACTGGTCCCTGGTCTGTGAGGAACCACCTGGGC
CACAGACTGGTCCTGGTCCCTGGTCTGTGAGGAACCAGGCCATACAGCA
GGAGGTAAGCGAGCATTCCTGCCTGAGCTCTGCCTCCTGTCAGATGAGC
CACAACATTAGATTCTCATAGGAGTGCGAACCCCGTTGTGAACCCCGCA
TGCGAGGGATCTAGGTAGTGCCCTCCTTAAGAGAATCTAATGTCTGATG
ATCTGAGGTAGAGCAGTTTCATCCTACAACCATCCCCACCCCCCGACCC
CCATCCATGAAAAAATTGTCTTCCTCAAAACTAGTCCCTGGTGCCAAAA
AGTTTGGGGACCGCCGTCCTAGGAAATACCAACAAAAAGTCACGTTTAT
TGCCTGCCAAGTGAGTCAGGTTTAGACAAGGCAGAACTTAGTATATAGC
TTGGATGAATCAGAAAGGGTGGGCCTTGAAAGACTGGTAGAATGTGTCC
AAGAAAACTGATTAAAAGCCTTAGAAGTCCCTCTACAGTTTCAGGACGC
CCTCTTAACAGATGGCTGTATCTTTATCTGTGGTTGGTCTTGTGGAATA

-continued

CTGACTTTCTGCCAGCATTAGCCTGTGTTTCTATGTCACACCAAGTCAC

GTATATTTTCATTGTGTGTTAGGACTCAGAATAGGTTTGGGTCTTTCTT

TTAATTATGTATACCCAATTACTTAGTCCTCCTCACACCCTGATCCTTT

AAAAATTCTTAAGTTGTGTTAATTGCATTTTTCTCAATTCTACTCCTAG

TAACTCTGTGTGTTTTTTTCCATCTTTATTCATTTAGTAAAGTTGAAAC

CTTTCATAGCATAATATAGTGATTAAGTGCATAGGTTTGGGACTTAGAC

ACACATGGGCTTGCTTGTCTCCCAGTTCTGCCGCTTACCACCTATGTGA

CCTTTCACTCTTTACCTTTCCACTCTTAGCCTGTTCTCTAACTATAAAA

TGAGAATGATGCTAGCGTCATCTTCATAGAGTGATTATGGAGATAAATA

AGTTAATGCATGTAAACCACTTTCCATAATGCCTGGCACATATTATATT

ATGTATTAGTAAATGTAAGCACTGGAAGAATCAGTAGTCTTCCTACACT

TGAAAATAGTTGTCTTCAACTATTGTTGTATTAATGAGTTAATTCACCT

TGTTAAGTCACCTTGATCCACCTAATTGTCAGCCAACATTTATTAACGA

AACTGCTAGTATTCGTATTGTGCCTTTTTTATTATGAAACATTTCAAGA

ATACAGAAAAATGCAGAAAACAATGTAACAAATACCTAAGTATCTATCA

CCCAACTTTTATAGTCTTATTTTTACCTATATATTTTTTCTTTTAGAAA

GGAATGATCACAGTTGTGCCTGAAATCTGTATAGCCCTGTCTCATTTCA

TTTGTCTCCCTTTACCCACATAAGTAATTGCAGCTCTGAATTTGATGTT

TATCAGAATGATACCATGAGTGGTTTTATATCCTTATTATATGTATGCA

TACCTAGGATTGTTTTTCTGATTTTGAAACTTCATATAAATGGTATCAT

TCTGTACAAAACCTTCTGGGACTTGTTTTACCACTCATGTTTTTGAGAT

GTATCCACACTACCATCTTTCTCTAAATCATTCATTTAAATGCTGTAGT

TCATTGAATAAGTTTATCACAATGTATCCATTTTCTTCTTGATGAGCAT

CTCAGTTATTTCCAATTTTTGACTTATAAACAATGCTGCAATGAAATAA

TTGACATATTTCCTTGTGTACATGTGAGCATTTCTTGAGATATGTATCT

AGAACTTGAATCACTGGCCAACAGGATATTCTTAATCTTCAGTTTCACC

AGATACTTCCAAATTGATCTCCATAACATGCATACCAAATTATATTCCT

ACCAGCCATTTATAGGAGTTCACATTTTTTCCATACCCTCCCAATCCTG

CCTTGGCAGATATGTTTTTTCCAATGAATAACAATGAAATTTTGTTTTG

GGATTTGACAAAATGATTCTAGATTCATCTGGAAGAAAAGCAAGTATAA

GTAAGAAATTTAAAAGGGACCTGAAAAACTAAGCAATGGATATATTTAA

AAATTGGTACCAGTAGGGATAACCAAATATTTGTTAACTGTAGCAGAAA

CAATGCATGTTTTTCTCACTGGTTCCACCTTCTATCTCTCAGTCAAGCC

CTGCCCAGGTGTGGTAGTCCTCATAGTCTCTCACTGTAGGGGTCTTCTC

ACATAGTAGACCACTCTCTTGAGTTGAATATTGAAAAGAAGGCTTGGCC

GGGGGCAGTGGCTCATGCCTGTGGTCCCAGCACTTTGGGAAGCTGAGTC

GAGCGGATTGCTTGAGGTCAGCAGTTCGAGAGCAGCCTGACTAACATGG

TGATGAAAAGTACAAAATTAGCTGGGGGTGGTGGCGCATGCCTGCAATC

CCAGCTACTCGGGAGGCTGAGGCACGAGAATCGCTTGAACGCAGGAGGC

ATAGGTTGCAGTGAGCCGAGATTGCACCACTGCACTCCAGCCTGGGCGA

CAGAGCAAGATTTCGTCTCAAAAAAAAAAAAAAAAAAAAAAAAAGGCTTA

-continued

AGTCCAACTAACTGTTTCCCTGCTGTTCATTTTATCCAACGGCTGGGGA

TATAGGCTACTGCACATGATGGGTTGATGGATGTGAAATGATAACTCAT

GACTTTAATTCTAATTTTTCTATATTCTGGTGAGGTTGAGCATATTTTT

ACAAGTTCATAATCCATTTTCCTCTGATGGGAGTTGCCTGTTTGAATCC

TTTGCCCACTTGCTTTTTGGGGTTATTTGCAATTTTTTGCATTGATCTT

CAAACATTCTTAATTAATCCCAGGTACATATTATTTTATATATAAGATA

TATTTTAGAGATATATAGGCTGATAGTATCTTTTCTCAGTCTAAGGCTT

ATCTTTTAATTTTGTTTATGGTGTTTTGTGTGTGTTGTTTTGCAGAAGT

TTTATTGTATCTGAATTGTGGCTTTTGTGTCTTAAGAAATTCTTTACCT

ACTGTCATAAAAATTTTTGTCTAAAAATTTTATGATTTTGCCTTTCTAT

TTATCTTGTTAATTCACTTTGAAATTACTTTTGTTTATGGCATAAAGTC

CATTATTTTCCATATGGATAATCAGTTGTCTTAGCAGTTTATTGAATGG

TCCAACGTTTCCCTGCTGATTATAATGCCCTCTCTGTTATTTATCCTAA

ATTCTTGACATCCGGTAAGGAAGTCTCCTCTGCCCACCCTTCTCTGTAT

TTCAAAATGGTTTTGACTGTTCTTGACCCCTTGCTCTTTCTGTGAACTT

TAGGATTAAATGATTATGTAGAATTAAACAATCGGGTTAAGGTTTTTTA

TTAGAATTACATTGAATCTATAGATTAATTTGGGGAAAGAATGTTATCT

TTCTATCCATGATAATTCTGTATCTCTCCATTAATTCAAGTCTTTAATG

GTTTTTAAAAATAAATTATTGTCTCTTTGAAAA, or a nucleic acid sequence that hybridizes to a nucleic acid sequence consisting of SEQ ID NO:274 under stringent hybridization conditions In some embodiments, SIX homeobox 1 (SIX1, BOS3, TIP39, DFNA23)) comprises the amino acid sequence:

(SEQ ID NO: 275; NP_005973.1)

MSMLPSFGFTQEQVACVCEVLQQGGNLERLGRFLWSLPACDHLHKNESV

LKAKAVVAFHRGNFRELYKILESHQFSPHNHPKLQQLWLKAHYVEAEKL

RGRPLGAVGKYRVRRKFPLPRTIWDGEETSYCFKEKSRGVLREVVYAHN

PYPSPREKRELAEATGLTTTQVSNWFKNRRQRDRAAEAKERENTENNNS

SSNKQNQLSPLEGGKPLMSSSEEEFSPPQSPDQNSVLLLQGNMGHARSS

NYSLPGLTASQPSHGLQTHQHQLQDSLLGPLTSSLVDLGS, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:275)

In some embodiments, the nucleic acid sequence encoding SIX1 comprises the nucleic acid sequence:

(SEQ ID NO: 276; NM_005982.4)

AAGTTCCCCGGCAACTAGCAGCATCCACCGGGCGGGAGGTCGGAGGCAG

CAAGGCCTTAAAGGCTACTGAGTGCGCCGGCCGTTCCGTGTCCAGAACC

TCCCCTACTCCTCCGCCTTCTCTTCCTTGGCCGCCCACCGCCAAGTTCC

GACTCCGGTTTTCGCCTTTGCAAAGCCTAAGGAGGAGGTTAGGAACAGC

-continued

CGCGCCCCCCTCCCTGCGGCCGCCGCCCCCTGCCTCTCGGCTCTGCTCC
CTGCCGCGTGCGCCTGGGCCGTGCGCCCCGGCAGGCCCCAGCCATGTCG
ATGCTGCCGTCGTTTGGCTTTACGCAGGAGCAAGTGGCGTGCGTGTGCG
AGGTTCTGCAGCAAGGCGGAAACCTGGAGCGCCTGGGCAGGTTCCTGTG
GTCACTGCCCGCCTGCGACCACCTGCACAAGAACGAGAGCGTACTCAAG
GCCAAGGCGGTGGTCGCCTTCCACCGCGGCAACTTCCGTGAGCTCTACA
AGATCCTGGAGAGCCACCAGTTCTCGCCTCACAACCACCCCAAACTGCA
GCAACTGTGGCTGAAGGCGCATTACGTGGAGGCCGAGAAGCTGCGCGGC
CGACCCCTGGGCGCCGTGGGCAAATATCGGGTGCGCCGAAAATTTCCAC
TGCCGCGCACCATCTGGGACGGCGAGGAGACCAGCTACTGCTTCAAGGA
GAAGTCGAGGGGTGTCCTGCGGGAGTGGTACGCGCACAATCCCTACCCA
TCGCCGCGTGAGAAGCGGGAGCTGGCCGAGGCCACCGGCCTCACCACCA
CCCAGGTCAGCAACTGGTTTAAGAACCGGAGGCAAAGAGACCGGGCCGC
GGAGGCCAAGGAAAGGGAGAACACCGAAAACAATAACTCCTCCTCCAAC
AAGCAGAACCAACTCTCTCCTCTGGAAGGGGGCAAGCCGCTCATGTCCA
GCTCAGAAGAGGAATTCTCACCTCCCCAAAGTCCAGACCAGAACTCGGT
CCTTCTGCTGCAGGGCAATATGGGCCACGCCAGGAGCTCAAACTATTCT
CTCCCGGGCTTAACAGCCTCGCAGCCCAGTCACGGCCTGCAGACCCACC
AGCATCAGCTCCAAGACTCTCTGCTCGGCCCCCTCACCTCCAGTCTGGT
GGACTTGGGGTCCTAAGTGGGGAGGGACTGGGGCCTCGAAGGGATTCCT
GGAGCAGCAACCACTGCAGCGACTAGGGACACTTGTAAATAGAAATCAG
GAACATTTTTGCAGCTTGTTTCTGGAGTTGTTTGCGCATAAAGGAATGG
TGGACTTTCACAAATATCTTTTTAAAAATCAAAACCAACAGCGATCTCA
AGCTTAATCTCCTCTTCTCTCCAACTCTTTCCACTTTTGCATTTTCCTT
CCCAATGCAGAGATCAGGGAAAAAAAAAAAAAAAAAACCCAAACAAACAA
AAGCACCCAGGCACCCAGTCTGAGTTCTGGGCAACTGATACGCCTGTTT
CAGCAGCCTTTCTTTTTTTTCAATGAATGGGAATTGCAAATCAACTGGA
TTTTCATTATTTCCTTTTAATTTATATATGGAGAAATGTGAAGAGGGAA
AGGAAATGGAAAGAGAAAGAGAAAGGGAGATAAAAATAGTGAAAATAAG
AGCCTCCAGGCTCAGAAGAACTGATTACATTCTTAAGGTGAACAGGAAA
AATACAATCTATAACTTTCTTTGATGAGGAAAAATTAAGTTTACATTTT
TCATATTTAGTGTTAAACAATTTAATGTAGATTAAAATAAAAGACCAGT
ATTAGGAGGAAAAAACAAGTGCCTAAATGTCTTAATGCTCTCTATGTGA
GACAGAAATAGACGTGACCATTAGTAATGCAACTATTTTTGTCAAATTT
AGTGGGATTTTTTGGTTGTTGTTTGTTTTCTTGGGTTTTTTTTTTTTTAA
ATGACAAACTCTAAAAATGTACCAATGTGAAAAAACACTTTCCTGAATG
CCATTACTCATGCCCTCAAAGCTTTCATATCTGTAGCCTACTCCTGTAA
AGGGTTTCTCCTGTTTCTAGTTTCTAGTTTGCAAAGGTATGCCAACGAA
TCTGGCAACCTGGTATTTGTTACTAAAACAGCATGTGTTTTCAGGTTTC
TTTTCTATTGTACCTAAAGCAGTCTAAATTAAAACTTAGTAGAACACCA
GGAGTATGATTCTGTTTCTGAAAGGTGAGTGGTGTATTGCTGTCATTGG
GCCCTATTTTTTTTTTTTAAATATATTTTTCTTTCTTACTTAATGGTGGC
TGTGAATTGCAGGGTACTTTGAAGGCCATCATCTGAACCAAGAGTAGTA
ACTAGATTAATTATATGACAGAAAGAGTGAATTTAGCCTTGGGGTATTT
ATTAACTTCTATTATTTAGATATGCAATTTTGTTTACCACTATCTCTTC
ACAGCATTCATATGTTAACTAAGCTCTTTTGTGTTAACAAGTTTATGAC
AAGACTGTGAAAGTAAAAATAATTTATCTGCTTGAAGACAAAAAAGGGA
AGGAGAACAAGGATAGAAACATTGTGAATTAATTTGTACAAATAGAAAG
CAGACCAGCAGGACAGGAGCTCTTTTGCAGTGCTGCCGGATGGTGTCTA
GAAAAATCCCAGTAATCATGTAGGCTCCATATTATTTTTGCCTGGGGCA
AAATGATGTATCTTCTGTATTTAGCTTTTAAAATTAGTGAAACAAATGG
CATTATTTATTAAAATTCTACTCAGGATAACAGGATTGGCTTGCTTGTG
CTTTGTAAAATATTGTTCCCCAGGGAGAATCTATTTATTTTCTGACATG
ACAGTTTCATAATTTTGATTTTTTCCCATCTATAATTGTCACCATTAAT
ATATTATTTCTTTCTTACTCTTTCCTATTTCTGTTCTGGTCTAGAAAAC
TGAGGTGTGCTTGGGGAAATCAAGGCCTTATTTTTTAAAACTGTCAAAT
AGCTTTGAGTTCCAGGGAGAAATGGTCACTGTACTTAACTGTACACACT
TTTACTTATAAAGTCGTTTTTCCCCCTCAGTGATGGACAGATGTGCACA
CAGCCACTCAGAGACCATCATTTGGTTTGGGAGCTCAGGGTCCCAATCT
CCCTTGTTAGTGTTTTGGATCATTAAGTCGGTGTTTATTTAAGTCACTA
GGGTGTTTATTCTCCCTGTCTTGGGCCACGGAGAAATGCCACCCTCTGC
AGGAGGGGCTCTCACAGGGAATCTCCTCACATTCTTCACATTCACTCCC
CAAAACAAACACCCTGCACAAAGATAGCTTTCAATGACCCTGACAGGCT
TCAAAGGACGCTGCGGAAATCTCTCTGGAAAATAGGAAGGGCCAATTAC
TTTAATTTCTTACATGCCGTCTCTTCCTACTCCGGTGACTACCCTCCAC
TCTCCCAGCTCCGCCTGGGATAATTTTAGGCTCGTGGAAGTTGTGTCTC
GCAGGGCGCCCCGGCCCACTTCCTGCTCCCTTAGTTGGTGAATCTTGGA
AATGTCTGCAGATCCGGCGAGGAGCAAGAGCGCTGGTCCTGTAAAAGCC
CCCGTGATTACTGCTTGTAAACTTGTTAAAAGGACAATTTTCTGTCACA
GTCATAAACTCTTTGTAAAACCCCTGGCACTAAATCCAGAGCGCGCATA
TTCCAGATGTGTTTAATAAGAAATTGCACAATGTGCCTCCTTCCGCCAT
CCTCGGCTCAGTCTGGGTAAAAGGGGCGAGCAGGAGGAGGCGAGAAAGC
TGGATATTGCTTTGAGTTTTTTTGGCAATCATTTCAGAGAGATCATTAG
GGGAAACTAACCATATTTTTTTCTTCCCTCGAGGAAATCTTCGAGAACC
AGCTGTTAAGGGACCTCCAGTTTACCTTCTGGGCGTCGCAGTTTAACTG
AATCTAAAGCCACTTTTCGTTTCTCCTCTACAGATGTCATAACGGTAGC
CAAAAGTAATGAACAACGGCTTATAAATAGTTTGTAGGACGAAACCATA
CAGCATTGTGCCAAGTGAAATGAAAAAAAAAAAAAA, or a nucleic acid sequence that hybridizes to a nucleic acid sequence consisting of SEQ ID NO:276 under stringent hybridization conditions In some embodiments, SIX homeobox 2 (SIX2) comprises the amino acid sequence:

(SEQ ID NO: 277; NP_058628.3)

MSMLPTFGFTQEQVACVCEVLQQGGNIERLGRFLWSLPACEHLHKNESV
LKAKAVVAFHRGNFRELYKILESHQFSPHNHAKLQQLWLKAHYIEAEKL
RGRPLGAVGKYRVRRKFPLPRSIWDGEETSYCFKEKSRSVLREVVYAHN
PYPSPREKRELAEATGLTTTQVSNWFKNRRQRDRAAEAKERENNENSNS
NSHNPLNGSGKSVLGSSEDEKTPSGTPDHSSSSPALLLSPPPPGLPSLH
SLGHPPGPSAVPVPVPGGGGADPLQHHHGLQDSILNPMSANLVDLGS, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:277)

In some embodiments, the nucleic acid sequence encoding SIX2 comprises the nucleic acid sequence:

(SEQ ID NO: 278; NM_016932.5)

AAGAAAGCTGAGAGCCAGCTAGACGGGAGGGAGAACGAGTGAGAAGCGA
GCGAGGGAACGGCGGGCGGGCGCGGAGCATGCGGAGCGGCGCCCCGGGC
GGCCCCCGGGCTTGGGCGAGGGCTTGGGCCAGGCGCGCGGGCCGTTGGG
GTTCGGAGCTTCGTGGGACCCGCGGCCGGCGCGGGGACGTACGGCAGTG
ACTCGGGGCTCACCGGGGGCCAGTGCCGGGCCAGGGGGCCAGCCCCGCC
CGCGTCTCGGCCCGGACGGCCCGGCGAGGAAGCTCCCATGCGGGACCGC
GCGGCCCGGTGAGGGCGCGCGCGGGCGGGCGGGGACGCAGCCGGCACCA
TGTCCATGCTGCCCACCTTCGGCTTCACGCAGGAGCAAGTGGCGTGCGT
GTGCGAGGTGCTGCAGCAGGGCGGCAACATCGAGCGGCTGGGCCGCTTC
CTGTGGTCGCTGCCCGCCTGCGAGCACCTTCACAAGAATGAAAGCGTGC
TCAAGGCCAAGGCCGTGGTGGCCTTCCACCGCGGCAACTTCCGCGAGCT
CTACAAGATCCTGGAGAGCCACCAGTTCTCGCCGCACAACCACGCCAAG
CTGCAGCAGCTGTGGCTCAAGGCACACTACATCGAGGCGGAGAAGCTGC
GCGGCCGACCCCTGGGCGCCGTGGGCAAATACCGCGTGCGCCGCAAATT
CCCGCTGCCGCGCTCCATCTGGGACGGCGAGGAGACCAGCTACTGCTTC
AAGGAAAAGAGTCGCAGCGTGCTGCGCGAGTGGTACGCGCACAACCCCT
ACCCTTCACCCCGCGAGAAGCGTGAGCTGGCGGAGGCCACGGGCCTCAC
CACCACACAGGTCAGCAACTGGTTCAAGAACCGGCGGCAGCGCGACCGG
GCGGCCGAGGCCAAGGAAAGGGAGAACAACGAGAACTCCAATTCTAACA
GCCACAACCCGCTGAATGGCAGCGGCAAGTCGGTGTTAGGCAGCTCGGA
GGATGAGAAGACTCCATCGGGGACGCCAGACCACTCATCATCCAGCCCC
GCACTGCTCCTCAGCCCGCCGCCCCCTGGGCTGCCGTCCCTGCACAGCC
TGGGCCACCCTCCGGGCCCCAGCGCAGTGCCAGTGCCGGTGCCAGGCGG
AGGTGGAGCGGACCCACTGCAACACCACCATGGCCTGCAGGACTCCATC
CTCAACCCCATGTCAGCCAACCTCGTGGACCTGGGCTCCTAGAACCCAT
TTGCCTTGATGAGCTTGCCTTTTGTGACTTGACACTGGGGACGTGGAGT

-continued

GGCGGTGTCCAGGGGCGCCCCGCCCCTGCGGCCCCACCAGGTACTGAAA
GACCCGCAGGCTGAGCGGGTAGAACAGCCGGGTAGGGCAGATAGCTGTC
TATGTTGGTTCTTGTTTGGGATTTATTTTCAACAAGTTACTTTTAGGAT
CCTTTTGGGGCTGGAGACTGAGTCTTGAACCACAGAAGGGAATAAATTA
TACACCACTGTCATTCTCTCTCCCTCTGTCTCTTCCTTTTACCCTCT
CTTGTCTTGCCTTTTCCCCCTTTCCTCTTCCTTTCCCTTCCTTCTCTTT
TCTTTTTTCTGCTTTCTGTCTTTCTCCCTCTCCTTGTATTGCTTTCCTT
CTAGATTTCTAGCTTGCCACCGTTCATTCTCTCCTTCTGTCTCTCCCTT
TCTCTCTCCTTCTCTGTTTCTCCTCTCTTCTCTCCTGCCAGTCTCTTGT
ACTCTGTGTCCTGGTCCCTCCGTATGTACCCCTGTCTTTCTCCTCCTGA
CTGGTGGTCTATCTGCCCCTACCTCTGGCCCTCGCTTTACCGGAGTAGG
GGGTGGGAGAGGGAAGAGGAGAGAAAATACAGGGACTTTGAACCTAGGC
CATCTCCTGAGGCCTTTTCCCTCGCCCATGTGGGTCAGTGGGAGCTGCA
GGTGTCAGCTTTTCGTCTAGTAACTTAAGTGAGAGAGAAAGGGCAGCGC
CACAGAAGCCCCTAAACGCCGCCTCGTCATACGCCCCTCCTCCTTCTCT
CTTGGCGAGGCCCCGCCACACCGCGCTCTTCCTCCCGGGACTGTGACTA
CAGCGCTCCCGGCTGAGCGCGCCCCCCGAGCCGCCGACTTGCCGTCTCC
CCGTAATGCCCTCATGTGAATGTTCTTCGGGAAATATTTCTGCTTTTAT
TTTATAATAAAATTAGAAATCATAAATATATAAATGGTTATATGCCACA
A, or a nucleic acid sequence that hybridizes to a nucleic acid sequence consisting of SEQ ID NO:278 under stringent hybridization conditions In some embodiments, EYA transcriptional coactivator and phosphatase 1 (EYA1, BOP, BOR, BOS1, OFC1) comprises the amino acid sequence:

(SEQ ID NO: 279; NP_000494.2)

MEMQDLTSPHSRLSGSSESPSGPKLGNSHINSNSMTPNGTEVKTEPMSS
SETASTTADGSLNNFSGSAIGSSSFSPRPTHQFSPPQIYPSNRPYPHIL
PTPSSQTMAAYGQTQFTTGMQQATAYATYPQPGQPYGISSYGALWAGIK
TEGGLSQSQSPGQTGFLSYGTSFSTPQPGQAPYSYQMQGSSFTTSSGIY
TGNNSLTNSSGFNSSQQDYPSYPSFGQGQYAQYYNSSPYPAHYMTSSNT
SPTTPSTNATYQLQEPPSGITSQAVTDPTAEYSTIHSPSTPIKDSDSDR
LRRGSDGKSRGRGRRNNNPSPPPDSDLERVFIWDLDETIIVFHSLLTGS
YANRYGRDPPTSVSLGLRMEEMIFNLADTHLFFNDLEECDQVHIDDVSS
DDNGQDLSTYNFGTDGFPAAATSANLCLATGVRGGVDWMRKLAFRYRRV
KEIYNTYKNNVGGLLGPAKREAWLQLRAEIEALTDSWLTLALKALSLIH
SRTNCVNILVTTTQLIPALAKVLLYGLGIVFPIENIYSATKIGKESCFE
RIIQRFGRKVVYVVIGDGVEEEQGAKKHAMPFWRISSHSDLMALHHALE
LEYL, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:279)

In some embodiments, the nucleic acid sequence encoding EYA1 comprises the nucleic acid sequence:

(SEQ ID NO: 280; NM_000503.6)

```
CTCAGATGCTATCTGCCGCTGCTGTTTGGTGGGGAAGGAGCGCTGGGCG
CAAAGCTGTTACCAAACAGAACGGTGGGAGCTGATGGCTCCGAGTTTGG
GGCGAGGTAGAAACTCTCCAGTGCCACTTCCGACTTTAAGCCTTCCTGT
TGCCGTCCACTGTGGCGGGTTTCTTCCTGGGGAACACGTTTTCGCTCAG
TCGCTCGGCAGCCCGAGCCTGCGGCAGCGGCCAGGCGCCTGCCCCCTGC
GCCGAGCTTTCCCCTGCAGAGGCGCTCCACTCCCAGAAGCGCCGCGGCT
GCACCAGAGCGCCTGAGAGCCCCCGCGCGTACCCATCCAGGAGCAAAAC
TATGTCAGGAATGGAGGTTTGCTAACCCAGAAAATTCGAAGGAACACAT
TAAACTGGTGGATGCAGCAGATGTAAGCGCTGTGCAAACATCTCAAGCC
AGTTCAGATGTTGCTGTTTCCTCAAGTTGCAGGTCTATGGAAATGCAGG
ATCTAACCAGCCCGCATAGCCGTCTGAGTGGTAGTAGTGAATCCCCCAG
TGGCCCCAAACTCGGTAACTCTCATATAAATAGTAATTCCATGACTCCC
AATGGCACCGAAGTTAAAACAGAGCCAATGAGCAGCAGTGAAACAGCTT
CAACGACAGCCGACGGGTCTTTAAACAATTTCTCAGGTTCAGCAATTGG
GAGCAGTAGTTTCAGCCCACGACCAACTCACCAGTTCTCTCCACCACAG
ATTTACCCTTCCAACAGACCATACCCACATATTCTCCCTACCCCTTCCT
CACAAACTATGGCTGCATATGGGCAAACACAGTTTACCACAGGAATGCA
ACAAGCTACAGCCTATGCCACGTACCCACAGCCAGGACAGCCGTACGGC
ATTTCCTCATATGGTGCATTGTGGGCAGGCATCAAGACTGAAGGTGGAT
TGTCACAGTCTCAGTCACCTGGACAGACAGGATTTCTCAGCTATGGCAC
AAGCTTCAGTACCCCTCAACCTGGACAGGCACCATACAGCTACCAGATG
CAAGGTAGCAGTTTTACAACATCATCAGGAATATATACAGGAAATAATT
CACTCACAAATTCCTCTGGATTTAATAGTTCACAGCAGGACTATCCGTC
TTATCCCAGTTTTGGCCAGGGTCAGTACGCACAGTATTATAACAGCTCA
CCGTATCCAGCACATTATATGACCAGCAGCAACACCAGCCCAACGACAC
CATCCACCAATGCCACTTACCAGCTTCAAGAACCGCCATCTGGCATCAC
CAGCCAAGCAGTTACAGATCCCACAGCAGAGTACAGCACAATCCACAGC
CCATCAACACCCATTAAAGATTCAGATTCTGATCGATTGCGTCGAGGTT
CAGATGGGAAATCACGTGGACGGGGCCGAAGAAACAATAATCCTTCACC
TCCCCCAGATTCTGATCTTGAGAGAGTGTTCATCTGGGACTTGGATGAG
ACAATCATTGTTTTCCACTCCTTGCTTACTGGGTCCTACGCCAACAGAT
ATGGGAGGGATCCACCCACTTCAGTTTCCCTTGGACTGCGAATGGAAGA
AATGATTTTCAACTTGGCAGACACACATTTATTTTTAATGACTTAGAA
GAATGTGACCAAGTCCATATAGATGATGTTTCTTCAGATGATAACGGAC
AGGACCTAAGCACATATAACTTTGGAACAGATGGCTTTCCTGCTGCAGC
AACCAGTGCTAACTTATGTTTGGCAACTGGTGTACGGGGCGGTGTGGAC
TGGATGAGAAAGTTGGCCTTCCGCTACAGACGGGTAAAAGAGATCTACA
ACACCTACAAAAATAATGTTGGAGGTCTGCTTGGTCCAGCTAAGAGGGA
```

-continued

```
AGCCTGGCTGCAGTTGAGGGCCGAAATTGAAGCCCTGACCGACTCCTGG
TTGACACTGGCCCTGAAAGCACTCTCGCTCATTCACTCCCGGACAAACT
GTGTGAATATTTTAGTAACAACTACTCAGCTCATCCCAGCATTGGCGAA
AGTCCTGCTGTATGGGTTAGGAATTGTATTTCCAATAGAAAATATTTAC
AGTGCAACTAAAATAGGAAAAGAAAGCTGTTTTGAGAGAATAATTCAAA
GGTTTGGAAGAAAAGTGGTGTATGTTGTTATAGGAGATGGTGTAGAAGA
AGAACAAGGAGCAAAAAAGCACGCGATGCCCTTCTGGAGGATCTCCAGC
CACTCGGACCTCATGGCCCTGCACCATGCCTTGGAACTGGAGTACCTGT
AACAGCGCTCGGCACTTTGACAGCGCACAGCTGCTCTGTGACCAGGGAC
AGATCCAGCAGGCCCCAGTCTCGCATCAGCGCCGGCCTCCAGAACTTAG
CAATTTCCGCCTGGTGATGCGCAGTTGCTGTCAGTCTTGACCTCTGCCT
TTGTGGTGAATGGAGGACCACGTCTATTTCATCAGAACAGCTGTTGACT
CTAGTACTGTGAATCCAGTGAAAATAAGCCATGAGAATGTTTTAGCACA
GCGTTATGTGTCTGCCACATTAACTACACGGTTCAAACCTGTGAAGAAA
GGACCTGCAAACGCTTCAGTTGTTAGCATTTTCAATGTGATATAAACAG
CTTCTCCAATACAGCAAACCTAATTGCACAACAGAGACTGAAATGTGTT
TCCTGAATACCAGTGGAGGAATTTTCTTGTAAAGAAGGTTTACTTTTTG
GTGTCTCATACCCAGGGTAATCTGTACATCTCTACTTATTTATGAACAG
ACTTTTTTTAAAAAGATAAAAAAACAGCTTTATTGAGGTATAATTCACC
CACCAGACTTTTTTAAACATCAAATAATTGAAGAGACAATAGCATTAGA
AATAAGTGATTAAAGGCCTCTGCCTCACAACATGGCAAGTACAGTACTT
TGAATTTTAGCACATTGCATAGTAGTTTTAAGTATGTCTAATTTAAACG
TATAATATGTACATCACTGAGACAATCATGTACAGAAAGAATTTTTGGT
GTAAATTTGTAATAATGGATAATTCTTTTACATATTGTTTAGGGAAATG
ATATTGAAAGGTAGCAATGCCTGGATAGTGAAGCATGAGGCAGCACGTG
CACAAATTCATGTGCCGTGCCTTATCTGAGTTTTCGGTATAAATATGTA
GATAATGGATTTTTTTTTTTTAGATAATGTTGTCAAGACCAAAAGCATG
GATGTCAAGTGTCAGTAAGGATTTTGTTTTCTAAAATTTTTTCCTGCAT
CAGTTCTTCTGAGGGCCTTGATGAAATAACACAGCAGTTTCTTAAACAA
TTTGAAACAAAATGAGCTCTCCTACCACCTCACTTTTTCATTTCCACAC
TAATGTATTATATGTAACTACTTGGAAAAAATAATTATTCAAATGCTTC
TTCCCACAAAGAATATAGATGATAGTAGATATATTTTATTAATAAAATG
GTTCATGAATCGGAGACTAACAAAGTTTTCATGTGCTCAGAATTATTAA
TTATCGTGTCTGCATTTTCTTTCGATAAAGGAAGACACACGATGCTAAT
CCGGAAATCAGCAAACTTTGCATTACTCCCTATGTGCGTATTTTCTCTT
TCTTCCTGTCACCCTGAGGAAGGTTCATTGCCATTGTCATCACCATGGA
AACAACGTTCCTCTCCACCTGCATTATGTACTACATGACAGGCATCAAT
CTGGGGAAATAATAAAATTATCACCTTTGTCAGACCATAAGAGTTTCTC
CAAAAGTGGTCAGTTTGGCTGGGCAATATTTTCTCTCATCTAACAAACA
CAATCCATTGTCATGAAATTACCCTTAGGATGAGTCTTCTTTAATCAAT
CATATATTGGGCGGGAAAAACACCAGCTTTGACCCGAAGTAGTTGAAGA
```

-continued

GCTACTTCATTCTTTTCTGAAGTTGTGTGTTGCTGCTAGAAATAGTCAT

TTGTGAATTATCCAAATTGTTTAAATTCACAATTGAATTAGTTTTTTCT

TCCTTTTTGCTTGAAGCAAACAGTTGACAATTTTTAACCTTTTCATTTT

ATGTTTTTGTACTCTGCAGACTGAAAAGACAAAGTTTATCTTGGCCTTA

CTGTATAAAGGTGTGCTGTGTCCACCGTTGTGTACAGAATTTTTCTTCA

TTAATTTTGTGTTTAAGTTAATAAAATTTATTTGTGATGTACTGTAA, or a nucleic acid sequence that hybridizes to a nucleic acid sequence consisting of SEQ ID NO:280 under stringent hybridization conditions In some embodiments, EYA transcriptional coactivator and phosphatase 2 (EYA2, EAB1) comprises the amino acid sequence:

(SEQ ID NO: 281; NP_005235.3)

MVELVISPSLTVNSDCLDKLKFNRADAAVWTLSDRQGITKSAPLRVSQLF

SRSCPRVLPRQPSTAMAAYGQTQYSAGIQQATPYTAYPPPAQAYGIPSYS

-continued

IKTEDSLNHSPGQSGFLSYGSSFSTSPTGQSPYTYQMHGTTGFYQGGNGL

GNAAGFGSVHQDYPSYPGFPQSQYPQYYGSSYNPPYVPASSICPSPLSTS

TYVLQEASHNVPNQSSESLAGEYNTHNGPSTPAKEGDTDRPHRASDGKLR

GRSKRSSDPSPAGDNEIERVFVWDLDETIIIFHSLLTGTFASRYGKDTTT

SVRIGLMMEEMIFNLADTHLFFNDLEDCDQIHVDDVSSDDNGQDLSTYNF

SADGFHSSAPGANLCLGSGVHGGVDWMRKLAFRYRRVKEMYNTYKNNVGG

LIGTPKRETWLQLRAELEALTDLWLTHSLKALNLINSRPNCVNVLVTTTQ

LIPALAKVLLYGLGSVFPIENIYSATKTGKESCFERIMQRFGRKAVYVVI

GDGVEEEQGAKKHNMPFWRISCHADLEALRHALELEYL, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:281)

In some embodiments, the nucleic acid sequence encoding EYA2 comprises the nucleic acid sequence:

(SEQ ID NO: 282; NM_005244.5)

AGCAGCCGCGGCAGCCCAGGAGGCGGAGGCAGCGGCAACGGCAGAGACAGCAA

CGTGCCCGCCGCAGTCAGCCCGGCCTCGTCGGACCCGCACCGGCCCGCCCGCCC

GCCCGCACCGCGTCGGGGCGCCCTCTCCACTGCGCGCGGTACAAGGAAATGGTA

GAACTAGTGATCTCACCCAGCCTCACTGTAAACAGCGATTGTCTGGATAAACTGAA

GTTTAACCGTGCTGACGCTGCTGTGTGGACTCTGAGTGACAGACAAGGCATCACCA

AATCGGCCCCCCTGAGAGTGTCCCAGCTCTTCTCCAGATCTTGCCCCACGTGTCCTC

CCCCGCCAGCCTTCCACAGCCATGGCAGCCTACGGCCAGACGCAGTACAGTGCG

GGGATCCAGCAGGCTACCCCCTATACAGCTTACCCACCTCCAGCACAAGCCTATG

GAATCCCTTCCTACAGCATCAAGACAGAAGACAGCTTGAACCATTCCCCTGGCCAG

AGTGGATTCCTCAGCTATGGCTCCAGCTTCAGCACCTCACCCACTGGACAGAGCCC

ATACACCTACCAGATGCACGGCACAACAGGGTTCTATCAAGGAGGAAATGGACTGG

GCAACGCAGCCGGTTTCGGGAGTGTGCACCAGGACTATCCTTCCTACCCCGGCTT

CCCCCAGAGCCAGTACCCCCAGTATTACGGCTCATCCTACAACCCTCCCTACGTCC

CGGCCAGCAGCATCTGCCCTTCGCCCCTCTCCACGTCCACCTACGTCCTCCAGGA

GGCATCTCACAACGTCCCCAACCAGAGTTCCGAGTCACTTGCTGGTGAATACAACA

CACACAATGGACCTTCCACACCAGCGAAAGAGGGAGACACAGACAGGCCGCACCG

GGCCTCCGACGGGAAGCTCCGAGGCCGGTCTAAGAGGAGCAGTGACCCGTCCCC

GGCAGGGGACAATGAGATTGAGCGTGTGTTCGTGTGGGACTTGGATGAGACAATA

ATTATTTTTCACTCCTTACTCACGGGGACATTTGCATCCAGATACGGGAAGGACACC

ACGACGTCCGTGCGCATTGGCCTTATGATGGAAGAGATGATCTTCAACCTTGCAGA

TACACATCTGTTCTTCAATGACCTGGAGGATTGTGACCAGATCCACGTTGATGACGT

CTCATCAGATGACAATGGCCAAGATTTAAGCACATACAACTTCTCCGCTGACGGCTT

CCACAGTTCGGCCCCAGGAGCCAACCTGTGCCTGGGCTCTGGCGTGCACGGCGG

CGTGGACTGGATGAGGAAGCTGGCCTTCCGCTACCGGCGGGTGAAGGAGATGTAC

AATACCTACAAGAACAACGTTGGTGGGTTGATAGGCACTCCCAAAAGGGAGACCTG

-continued

```
GCTACAGCTCCGAGCTGAGCTGGAAGCTCTCACAGACCTCTGGCTGACCCACTCC
CTGAAGGCACTAAACCTCATCAACTCCCGGCCCAACTGTGTCAATGTGCTGGTCAC
CACCACTCAACTAATTCCTGCCCTGGCCAAAGTCCTGCTATATGGCCTGGGGTCTG
TGTTTCCTATTGAGAACATCTACAGTGCAACCAAGACAGGGAAGGAGAGCTGCTTC
GAGAGGATAATGCAGAGATTCGGCAGAAAAGCTGTCTACGTGGTGATCGGTGATG
GTGTGGAAGAGGAGCAAGGAGCGAAAAAGCACAACATGCCTTTCTGGCGGATATC
CTGCCACGCAGACCTGGAGGCACTGAGGCACGCCCTGGAGCTGGAGTATTTATAG
CAGGATCAGCAGCATCTCCACCTGCCATCTCACCCTCAGACCCCCTCGCCTTCCCC
ACCTCCCCACCGAGAACTCCAGAGACCCAGATGTTGGACACCAGGAAGGGGCCCC
ACAGCCGAGACGACGTGTCCAGTGACCATCTCAGAAGCCGTCCATCAGTCCAAAT
GGGGGTTCTGAGAAGGAAAGTACCCAACATTGGCTTCGGAGTATTTGACTTTGGGG
AAAAGGGCTGGCTCGGAGTCTAGACTCTTCTGTAAGACTCACAGAACAAAAGCAAG
GAATTGCTGATTTGGGGGGTGCCTGGTGATGAGGAGGGGATGGGTTTGTCTTGTC
TTCTTTTTAATTTATGGACTAGTCTCATTACTCCGGAATTATGCTCTTGTACCTGTGT
GGCTGGGTTTCTTAGTCGTTGGTTTGGTTTGGTTTTTTGAACTGGTATGTGGGGTG
GTTCACAGTTCTAATGTAAGCACTCTATTCTCCAAGTTGTGCTTTGTGGGGACAATC
ATTCTTTGAACATTAGAGAGGAAGGCAGTTCAAGCTGTTGAAAAGACTATTGCTTAT
TTTTGTTTTTAAAGACCTACTTGACGTCATGTGGACAGTGCACGTGCCTTACGCTAC
ATCTTGTTTTCTAGGAAGAGGGGGATGCTGGGAAGGAATGGGTGCTTTGTGATGGA
TAAAAGGCATTAAATAAAACCACGTTTACATTTTGAA,
```

or a nucleic acid sequence that hybridizes to a nucleic acid sequence consisting of SEQ ID NO:282 under stringent hybridization conditions In some embodiments, ETS variant transcription factor 4 (PEA3, ETV4, E1AF, PEAS3) comprises the amino acid sequence:

```
                         (SEQ ID NO: 283; NP_001073143.1)
MERRMKAGYLDQQVPYTFSSKSPGNGSLREALIGPLGKLMDPGSLPPLDS
EDLFQDLSHFQETWLAEAQVPDSDEQFVPDFHSENLAFHSPTTRIKKEPQ
SPRTDPALSCSRKPPLPYHHGEQCLYSSAYDPPRQIAIKSPAPGALGQSP
LQPFPRAEQRNFLRSSGTSQPHPGHGYLGEHSSVFQQPLDICHSFTSQGG
GREPLPAPYQHQLSEPCPPYPQQSFKQEYHDPLYEQAGQPAVDQGGVNGH
RYPGAGVVIKQEQTDFAYDSDVTGCASMYLHTEGFSGPSPGDGAMGYGYE
KPLRPFPDDVCVVPEKFEGDIKQEGVGAFREGPPYQRRGALQLWQFLVAL
LDDPTNAHFIAWTGRGMEFKLIEPEEVARLWGIQKNRPAMNYDKLSRSLR
YYYEKGIMQKVAGERYVYKFVCEPEALFSLAFPDNQRPALKAEFDRPVSE
EDTVPLSHLDESPAYLPELAGPAQPFGPKGGYSY,
```

or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:283)

In some embodiments, the nucleic acid sequence encoding PEA3 comprises the nucleic acid sequence:

```
                         (SEQ ID NO: 284; NM_001079675.5)
GCTCACAACTGTCTGCTGCGCCCGAAAAACAAGTCGGTGCGCTGGGGACC
CGGGGCCGGGGCCGCCTTACTCCGGCCTAGCCCCGCGGCCCTCGGTGCGG
GCTCCAGGGCATGCTCGGGACCCCCCGCGGCTCCAGCCCAGACGCCCCGG
CCTCAGGTCTCGGCCCCCGCTTGGGGCCCCGGCCGTGCGGCCGGAGGGAG
CGGCCGGATGGAGCGGAGGATGAAAGCCGGATACTTGGACCAGCAAGTGC
CCTACACCTTCAGCAGCAAATCGCCCGGAAATGGGAGCTTGCGCGAAGCG
CTGATCGGCCCGCTGGGGAAGCTCATGGACCCGGGCTCCCTGCCGCCCCT
CGACTCTGAAGATCTCTTCCAGGATCTAAGTCACTTCCAGGAGACGTGGC
TCGCTGAAGCTCAGGTACCAGACAGTGATGAGCAGTTTGTTCCTGATTTC
CATTCAGAAAACCTAGCTTTCCACAGCCCCACCACCAGGATCAAGAAGGA
GCCCCAGAGTCCCCGCACAGACCCGGCCCTGTCCTGCAGCAGGAAGCCGC
CACTCCCCTACCACCATGGCGAGCAGTGCCTTTACTCCAGTGCCTATGAC
CCCCCCAGACAAATCGCCATCAAGTCCCCTGCCCCTGGTGCCCTTGGACA
GTCGCCCCTACAGCCCTTTCCCCGGGCAGAGCAACGGAATTTCCTGAGAT
CCTCTGGCACCTCCCAGCCCCACCCTGGCCATGGGTACCTCGGGGAACAT
AGCTCCGTCTTCCAGCAGCCCCTGGACATTTGCCACTCCTTCACATCTCA
GGGAGGGGGCCGGGAACCCCTCCCAGCCCCCTACCAACACCAGCTGTCGG
```

-continued

AGCCCTGCCCACCCTATCCCCAGCAGAGCTTTAAGCAAGAATACCATGAT

CCCCTGTATGAACAGGCGGGCCAGCCAGCCGTGGACCAGGGTGGGGTCAA

TGGGCACAGGTACCCAGGGGCGGGGGTGGTGATCAAACAGGAACAGACGG

ACTTCGCCTACGACTCAGATGTCACCGGGTGCGCATCAATGTACCTCCAC

ACAGAGGGCTTCTCTGGGCCCTCTCCAGGTGACGGGGCCATGGGCTATGG

CTATGAGAAACCTCTGCGACCATTCCCAGATGATGTCTGCGTTGTCCCTG

AGAAATTTGAAGGAGACATCAAGCAGGAAGGGGTCGGTGCATTTCGAGAG

GGGCCGCCCTACCAGCGCCGGGGTGCCCTGCAGCTGTGGCAATTTCTGGT

GGCCTTGCTGGATGACCCAACAAATGCCCATTTCATTGCCTGGACGGGCC

GGGGAATGGAGTTCAAGCTCATTGAGCCTGAGGAGGTCGCCAGGCTCTGG

GGCATCCAGAAGAACCGGCCAGCCATGAATTACGACAAGCTGAGCCGCTC

GCTCCGATACTATTATGAGAAAGGCATCATGCAGAAGGTGGCTGGTGAGC

GTTACGTGTACAAGTTTGTGTGTGAGCCCGAGGCCCTCTTCTCTTTGGCC

TTCCCGGACAATCAGCGTCCAGCTCTCAAGGCTGAGTTTGACCGGCCTGT

CAGTGAGGAGGACACAGTCCCTTTGTCCCACTTGGATGAGAGCCCCGCCT

ACCTCCCAGAGCTGGCTGGCCCCGCCCAGCCATTTGGCCCCAAGGGTGGC

TACTCTTACTAGCCCCCAGCGGCTGTTCCCCCTGCCGCAGGTGGGTGCTG

CCCTGTGTACATATAAATGAATCTGGTGTTGGGGAAACCTTCATCTGAAA

CCCACAGATGTCTCTGGGGCAGATCCCCACTGTCCTACCAGTTGCCCTAG

CCCAGACTCTGAGCTGCTCACCGGAGTCATTGGGAAGGAAAAGTGGAGAA

ATGGCAAGTCTAGAGTCTCAGAAACTCCCCTGGGGGTTTCACCTGGGCCC

TGGAGGAATTCAGCTCAGCTTCTTCCTAGGTCCAAGCCCCCCACACCTTT

TCCCCAACCACAGAGAACAAGAGTTTGTTCTGTTCTGGGGGACAGAGAAG

GCGCTTCCCAACTTCATACTGGCAGGAGGGTGAGGAGGTTCACTGAGCTC

CCCAGATCTCCCACTGCGGGGAGACAGAAGCCTGGACTCTGCCCCACGCT

GTGGCCCTGGAGGGTCCCGGTTTGTCAGTTCTTGGTGCTCTGTGTTCCCA

GAGGCAGGCGGAGGTTGAAGAAAGGAACCTGGGATGAGGGGTGCTGGGTA

TAAGCAGAGAGGGATGGGTTCCTGCTCCAAGGGACCCTTTGCCTTTCTTC

TGCCCTTTCCTAGGCCCAGGCCTGGGTTTGTACTTCCACCTCCACCACAT

CTGCCAGACCTTAATAAAGGCCCCCACTTCTCCCA, or a nucleic acid sequence that hybridizes to a nucleic acid sequence consisting of SEQ ID NO:284 under stringent hybridization conditions In some embodiments, nuclear factor of activated T cells 5 (NFAT5, NFATZ, OREBP, NF-ATS, NFATL1, TONEBP) comprises the amino acid sequence:

(SEQ ID NO: 285; NP_001106649.1)

MPSDFISLLSADLDLESPKSLYSRDSLKLHPSQNFHRAGLLEESVYDLLP

KELQLPPSRETSVASMSQTSGGEAGSPPPAVVAADASSAPSSSSMGGACS

SFTTSSSPTIYSTSVTDSKAMQVESCSSAVGVSNRGVSEKQLTSNTVQQH

PSTPKRHTVLYISPPPEDLLDNSRMSCQDEGCGLESEQSCSMWMEDSPSN

FSNMSTSSYNDNTEVPRKSRKRNPKQRPGVKRRDCEESNMDIFDADSAKA

PHYVLSQLTTDNKGNSKAGNGTLENQKGTGVKKSPMLCGQYPVKSEGKEL

KIVVQPETQHRARYLTEGSRGSVKDRTQQGFPTVKLEGHNEPVVLQVFVG

NDSGRVKPHGFYQACRVTGRNTTPCKEVDIEGTTVIEVGLDPSNNMTLAV

DCVGILKLRNADVEARIGIAGSKKKSTRARLVFRVNIMRKDGSTLTLQTP

SSPILCTQPAGVPEILKKSLHSCSVKGEEEVFLIGKNFLKGTKVIFQENV

SDENSWKSEAEIDMELFHQNHLIVKVPPYHDQHITLPVSVGIYVVTNAGR

SHDVQPFTYTPDPAAGALNVNVKKEISSPARPCSFEEAMKAMKTTGCNLD

KVNIIPNALMTPLIPSSMIKSEDVTPMEVTAEKRSSTIFKTTKSVGSTQQ

TLENISNIAGNGSFSSPSSSHLPSENEKQQQIQPKAYNPETLTTIQTQDI

SQPGTFPAVSASSQLPNSDALLQQATQFQTRETQSREILQSDGTVVNLSQ

LTEASQQQQQSPLQEQAQTLQQQISSNIFPSPNSVSQLQNTIQQLQAGSF

TGSTASGSSGSVDLVQQVLEAQQQLSSVLFSAPDGNENVQEQLSADIFQQ

VSQIQSGVSPGMFSSTEPTVHTRPDNLLPGRAESVHPQSENTLSNQQQQQ

QQQQQVMESSAAMVMEMQQSICQAAAQIQSELFPSTASANGNLQQSPVYQ

QTSHMMSALSTNEDMQMQCELFSSPPAVSGNETSTTTTQQVATPGTTMFQ

TSSSGDGEETGTQAKQIQNSVFQTMVQMQHSGDNQPQVNLFSSTKSMMSV

QNSGTQQQGNGLFQQGNEMMSLQSGNFLQQSSHSQAQLFHPQNPIADAQN

LSQETQGSLFHSPNPIVHSQTSTTSSEQMQPPMFHSQSTIAVLQGSSVPQ

DQQSTNIFLSQSPMNNLQTNTVAQEAFFAAPNSISPLQSTSNSEQQAAFQ

QQAPISHIQTPMLSQEQAQPPQQGLFQPQVALGSLPPNPMPQSQQGTMFQ

SQHSIVAMQSNSPSQEQQQQQQQQQQQQQQQQQSILFSNQNTMATMASPK

QPPPNMIFNPNQNPMANQEQQNQSIFHQQSNMAPMNQEQQPMQFQSQSTV

SSLQNPGPTQSESSQTPLFHSSPQIQLVQGSPSSQEQQVTLFLSPASMSA

LQTSINQQDMQQSPLYSPQNNMPGIQGATSSPQPQATLFHNTAGGTMNQL

QNSPGSSQQTSGMFLFGIQNNCSQLLTSGPATLPDQLMAISQPGQPQNEG

QPPVTTLLSQQMPENSPLASSINTNQNIEKIDLLVSLQNQGNNLTGSF, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:285)

In some embodiments, the nucleic acid sequence encoding NFAT5 comprises the nucleic acid sequence:

(SEQ ID NO: 286; NM_001113178.3)

AGATTCCTGTCAGCGGCGGCGGCGGTGGCGGCGACCGTCAGTTTTCGCTGAGGA

GAAACACGAAACGGACCCTTTGGCTCTCCCCCTTCCCCTTCCCCGTCCTGAACCCC

TCTCCTGGTCACCGAGAATCAGTCCCCGTGGAGTTCCCCCTCCACCTCGCCATCGT

-continued

TTCCTCGGTCCTCGGCCCAGTGGAAGTCACTACCCTCGAGGAGGAGGCAGCGGCA

GCCGCCCTCGCGTCGCCGCCCCCGGTTCGGTGCCCGCGGTCCCGGAGAGGAGGT

GCCGCCGCCACCGCCGCTCCCCCCCTCCCGCTGCCCTCGGGCCGGGCTGGGTCG

AGCTGCGATGCCCTCGGACTTCATCTCATTGCTCAGCGCGGACCTAGACCTGGAAT

CGCCCAAGTCCCTCTACTCGCGAGATTCTCTGAAGTTACACCCATCACAGAATTTTC

ATAGAGCTGGACTATTGGAAGAATCTGTCTATGATCTTCTCCCAAAGGAGTTACAGT

TACCTCCATCTAGAGAAACATCTGTAGCATCAATGAGTCAGACAAGCGGTGGTGAG

GCAGGCTCGCCTCCTCCAGCTGTTGTTGCTGCTGATGCTTCTTCAGCTCCCTCCTC

TTCCTCCATGGGCGGTGCTTGCAGCTCCTTTACCACCTCTTCCAGCCCTACCATTTA

TTCTACCTCAGTCACCGACAGCAAGGCTATGCAAGTGGAGAGCTGCTCCTCAGCC

GTGGGGGTAAGTAACAGAGGGGTAAGTGAAAAGCAGTTAACCAGTAACACAGTTCA

GCAGCATCCATCAACACCGAAGAGGCACACAGTCTTGTACATCTCACCACCACCTG

AGGACTTGCTGGATAACAGTCGGATGTCCTGCCAGGATGAGGGGTGTGGATTGGA

ATCTGAGCAGAGCTGCAGTATGTGGATGGAGGATTCCCCCTCCAACTTCAGTAACA

TGAGCACCAGTTCCTACAATGATAACACTGAGGTACCTCGTAAATCACGAAAACGA

AATCCAAAGCAGAGGCCGGGGGTCAAACGACGAGATTGTGAAGAATCTAATATGGA

TATATTTGATGCCGACAGTGCCAAAGCACCTCACTATGTGCTTTCTCAGCTTACCAC

GGACAACAAAGGCAACTCAAAAGCGGGAAATGGAACATTGGAAAACCAAAAAGGAA

CTGGAGTAAAGAAGAGCCCTATGTTGTGTGGACAATATCCTGTTAAAAGTGAGGGA

AAGGAGCTGAAGATAGTTGTACAACCTGAGACACAGCACCGAGCTCGGTACCTGA

CTGAGGGCAGCCGTGGCTCAGTGAAAGATAGAACACAGCAAGGCTTTCCTACAGT

AAAGCTGGAAGGCCATAATGAACCTGTAGTGTTGCAAGTGTTTGTGGGCAACGACT

CTGGACGAGTGAAACCACATGGATTTTATCAGGCCTGCAGAGTAACTGGACGAAAT

ACAACTCCTTGCAAAGAAGTGGACATTGAAGGCACTACTGTTATAGAAGTCGGCCT

TGATCCTAGCAACAACATGACACTGGCGGTGGACTGCGTAGGGATATTGAAATTGA

GGAATGCTGATGTCGAAGCCAGAATAGGAATTGCTGGTTCCAAGAAGAAAAGCACT

CGTGCCAGATTGGTTTTTCGAGTTAATATCATGAGGAAAGATGGCTCCACTTTGACA

CTGCAAACACCCTCTTCTCCAATTTTGTGTACTCAGCCAGCAGGAGTGCCAGAAAT

CTTAAAGAAAAGCTTGCATAGCTGTTCAGTGAAAGGAGAAGAAGAAGTGTTTTTAAT

CGGCAAGAACTTTCTGAAAGGAACTAAAGTTATTTTCCAAGAAAATGTTTCTGATGA

AAACTCTTGGAAGTCAGAAGCTGAAATTGATATGGAACTATTTCATCAGAATCATCT

TATTGTGAAGGTTCCTCCCTATCATGACCAACATATAACTTTGCCTGTGTCAGTGGG

AATATATGTAGTGACAAATGCTGGAAGATCTCATGATGTTCAACCATTCACTTACAC

TCCAGACCCAGCAGCTGGTGCTTTGAATGTAAATGTGAAGAAGGAAATATCTAGTC

CAGCAAGACCTTGCTCTTTTGAAGAGGCCATGAAAGCAATGAAAACTACTGGATGT

AATTTAGATAAGGTAAATATTATCCCTAATGCCCTGATGACTCCACTCATACCAAGC

AGTATGATTAAGAGTGAAGATGTTACTCCAATGGAAGTAACAGCAGAAAAAAGATCT

TCCACTATTTTTAAGACTACAAAGTCTGTTGGATCAACTCAGCAAACATTAGAAAACA

TCTCAAACATAGCAGGAAATGGCTCTTTTTCATCACCATCATCTTCCCACCTACCTT

CTGAAAATGAAAAACAGCAGCAGATTCAGCCCAAGGCATACAACCCAGAGACCCTG

ACAACTATTCAAACCCAGGACATCTCACAGCCTGGTACTTTTCCAGCAGTTTCTGCT

-continued

TCTAGTCAGCTGCCCAACAGCGATGCACTATTGCAGCAGGCTACACAGTTTCAGAC

AAGAGAAACTCAGTCTAGAGAGATATTACAGTCAGATGGTACAGTGGTTAATTTGTC

ACAACTGACTGAGGCATCACAACAACAGCAGCAGTCACCACTACAAGAACAAGCAC

AGACTTTACAGCAGCAGATTTCATCAAATATTTTTCCATCACCAAATAGTGTGAGTCA

GCTTCAGAATACTATTCAGCAGCTGCAAGCAGGGAGTTTCACAGGCAGTACTGCTA

GTGGCAGCAGTGGAAGTGTTGACTTGGTCCAACAAGTTTTAGAGGCACAGCAGCA

GTTATCTTCAGTTTTATTTTCTGCTCCAGATGGTAATGAGAATGTTCAAGAGCAGCTT

AGTGCAGATATTTTTCAACAAGTCAGTCAAATTCAGAGTGGTGTAAGCCCTGGAATG

TTTTCCTCAACAGAGCCAACAGTCCATACCAGACCAGATAATTTATTACCTGGAAGA

GCTGAAAGTGTTCATCCACAGTCTGAAAACACGTTATCTAATCAACAGCAGCAGCA

GCAGCAGCAACAGCAAGTGATGGAATCTTCAGCCGCAATGGTGATGGAGATGCAA

CAGAGTATCTGCCAGGCAGCTGCCCAGATTCAGTCAGAGTTATTCCCTTCAACTGC

TTCAGCAAATGGAAACCTTCAGCAATCGCCAGTTTACCAGCAGACTTCTCACATGAT

GAGTGCATTGTCTACCAATGAGGATATGCAAATGCAGTGTGAATTGTTTTCTTCTCC

TCCTGCAGTTTCTGGAAATGAAACTTCTACAACTACCACACAGCAGGTTGCAACCC

CTGGCACTACCATGTTTCAGACATCAAGTTCAGGAGATGGAGAAGAAACTGGAACA

CAAGCAAAACAGATTCAGAACAGTGTCTTTCAGACCATGGTCCAAATGCAACATAGT

GGGGACAATCAACCTCAAGTTAACCTTTTTTCATCCACAAAAAGTATGATGAGTGTT

CAGAATAGTGGTACCCAACAACAAGGTAATGGTTTATTCCAGCAAGGGAATGAGAT

GATGTCACTTCAATCTGGAAATTTTTTGCAGCAGTCTTCTCATTCACAGGCCCAACT

TTTTCATCCTCAAAATCCTATTGCCGATGCTCAGAACCTTTCCCAGGAAACTCAAGG

TTCTCTCTTTCATAGTCCAAATCCTATTGTCCACAGTCAGACTTCTACAACCTCCTCT

GAACAAATGCAGCCTCCAATGTTTCACTCTCAAAGTACCATTGCTGTGTTACAGGGC

TCTTCAGTTCCTCAAGACCAGCAGTCAACCAACATATTTCTTTCCCAGAGTCCCATG

AATAATCTTCAGACTAACACAGTAGCCCAAGAAGCATTTTTTGCAGCACCGAACTCA

ATTTCTCCACTTCAGTCAACATCAAACAGTGAACAACAAGCTGCTTTCCAACAGCAA

GCTCCAATATCACACATCCAGACTCCTATGCTTTCCCAAGAACAGGCACAACCCCC

GCAGCAGGGTTTATTTCAGCCTCAGGTGGCCCTGGGCTCCCTTCCACCTAATCCAA

TGCCTCAAAGCCAACAAGGAACCATGTTCCAGTCACAGCACTCAATAGTTGCCATG

CAGAGTAACTCTCCATCCCAGGAACAGCAGCAGCAGCAGCAACAGCAGCAGCAAC

AGCAGCAGCAACAACAACAGAGCATTTTATTCAGTAATCAGAATACCATGGCTACAA

TGGCGTCTCCAAAGCAACCACCACCAAACATGATATTCAACCCAAATCAAAATCCAA

TGGCTAATCAGGAGCAACAGAACCAGTCAATTTTTCACCAACAAAGTAACATGGCC

CCAATGAATCAAGAGCAACAGCCCATGCAATTTCAGAGTCAGTCCACAGTTTCCTC

ACTTCAGAACCCAGGTCCTACCCAGTCGGAATCATCACAGACCCCCTTGTTCCATA

GCTCTCCTCAGATTCAGTTGGTACAAGGGTCACCTAGTTCTCAAGAGCAGCAAGTA

ACTCTCTTCTTATCTCCAGCATCCATGTCTGCCTTGCAGACCAGTATAAATCAACAA

GATATGCAACAGTCTCCTCTTTATTCCCCTCAGAACAACATGCCTGGAATTCAAGGA

GCCACATCTTCGCCTCAACCACAGGCTACTTTATTTCACAACACAGCAGGAGGCAC

AATGAACCAACTGCAGAATTCTCCTGGCTCATCTCAGCAGACATCAGGAATGTTCTT

-continued

ATTTGGCATTCAAAATAACTGTAGTCAGCTTTTAACCTCTGGACCAGCTACATTGCC

TGATCAGTTGATGGCCATAAGTCAGCCAGGCCAACCACAAAACGAGGGCCAGCCA

CCTGTGACAACACTTCTTTCTCAGCAAATGCCAGAGAATTCTCCACTGGCATCCTCT

ATAAACACCAACCAGAACATCGAAAAGATTGATTTGCTTGTTTCATTGCAAAACCAA

GGGAACAACTTGACTGGCTCCTTTTAACTGGATATAAATTCCACGAAGAAAATCCTG

ATTCCAAGATGTCCTGAGATCTTGTGGTTCCATGAGAATTATTACTTTAAAAACAAAA

CAAAATATAAAAAACTGTGTTTGAGTAAACTGATAGATTTTACTCTGACTGCAAAAGA

GCACACCTATGCTGCTTGTTGCAGTAACTAACCACCAATGTTAACATCTTCATATTTT

ATATTCCTAATAACAGTGATGACTGAGAATCTATTTGAGTTTCCAGCTGGCAGAATT

AATTGTTATTATTTTCCTAGGCGCAATTTCCTTAAACGTACAGTTTAAATTCAAGGCT

GGACCACTCAGTTATTATTGCTATTAGAAAATAATATATCATGTTTACTTTTGTTCTTC

ATTATTTTCTTTCCTGCATTGTTTTAGTCAAGTAATGGCTTTTGAAAAAGTAAAGTTC

AATAATAACTAAGGCTGTGATTTTTTTCAATATAAAAGGCACAGCTGTTGGCCAAAG

TGAAGGAATCTTTTTTCAGTTTTATTGGAGAAACTGAAGGGTAACATTCTAACAAGTA

AACTGTATGTGCAGATAAAAGTACTCTTGATTTAACACAAAGGCAGATGATACACTT

ATAAAACTGGGAACAGCTGGAATGCTTCTTGATTTTATTTTTTCAGAGAGTTGTTAGT

TCTCTGGGTTTCTACTAAGGGGTTTAGCCATAACTGTGCATAGAAAAATAATTATCT

GTAAAAAATGAAGGGGATAATATATGATAAATTATGTTCTGATATCCTCCTACAGTAG

TTTAAATTGACAGAAAAATTTGAATGTTTTCTTCTTAACCCAGTCTTAGGCTGGTATT

CCCTTTTTATATATATCTATATTACTTTTCACCTCTTTTTCACTTTACTTTAGAGAACT

ATTAATATACTACTGGCTTCATGACCCTGTAGCATCTTTGGCCACTTTAATCTAGGG

TGACCTAGCAATCCTGCAGCACAGGGCAGAGAGTACTGTCTTAGGAATTATTAGGA

GTTGATTCCTGAGAAACAACACATTTTTCCCCATGAACGGTGCTGTTCTGAAGTCTT

CAAATTTTTCCCTCTAATAGGAAACAGTATAAATTTTAATTAAAAAAAAAAGGCAAAC

TAAAATTTCTTGAAATATCACTTCTCCCTGATCTGCAGTGAGTATAAATTCACTTGTC

ACCTCAGTGCTTTACAGTTTGAAGTGGTCACTTACCTGATGGTTCCCACAAGCCTTA

GGCTTTACAGGGTTGTATCATTGACTTAAAATGAAGAATTAACTTGTGTTACATCTAT

AAAGAGCAAAATAACACACTCCAGAACTTGGCAGTTGTAGCATTAGTTATACAGTTT

TGGGTGTTCTTGCCACCCGTGGGATGCCTGCTTCTCACTACCACCTGTGTCTGGAC

ACATGCTTATGTCTCATTTTCCTTTTGGCATGTGGAAAGCTGTCAATGCAGTGTAAG

GCCAACGTGTGTGTGGCTTCTATGTGTTGAGATAATGTTTTGGTATCCTTGTCCGTT

TCATTTATTTTTTAAGTGTACAAAAAATAACCTGTTAATTGTTGAAGGCTACTTTTCTG

TTCTTTTTTTTTTTTTTTTTCTATCCTGTACATTTAGTTGAACTGTGCGGAATTGTGGT

GTTGGTTTTGTTTACACAGCCAGATTTTTCCTTCTTTTTGTTTTGTGATGATCTTCCTT

TGTTCTTTGAATGTGCTCTTTTGTCTTTTTCTCTTTTTTCTCATGTTTTCTTCCCTCCA

CCTCCACCCCTTTCTTTCTTTCTCTCTCTGATTGAGAGGCATTGAATTACGTTTTCAG

TAGTACAGGCTTCTTGCCGATATGAAGGGAACTTTTCAGAAAGAGACCTACTCTGG

GTCATTTAATTTTGAATACAGTTTTCAATCGTTCAAGTTTTGGATGGTTTATATCTAAT

GTGTGTTTCATTTTTTTGGAAAGCTATATTTTGTATTTAGGAAATGGTATACTATTTTG

CTATTTGTACTGAGTGAGTACATTGGCATAAATATAGAAATTTATATATATACATATAT

ATAAACTATTCTTTTTTGCCACACATTTTTGTGGTAAATTTGTGAGTTTGTCTGATGTT

-continued

CTACCACAACGTGGCGTCTGATAACAGTGAGGGGGGGTGGGGTTTGTTATGTCTTT

ATTGAGTATTTAAGTATCTTTTGAAACAAATGACCTGTTCATCTGTGGCCATTCCATC

AGGCAGTTAGTTCCTTGATGTCAGTAGTGGGCTAAAGGCAGCTTACTGTGTGTTTG

CTGGAGCTTTCACTCAGCCAAGTGTTAGAGTCAGGAAACCCATTGAGGCAATGGCG

TCAAATGGTGTTTCACAAGAATGAGCCATTCAGTCTTTGCTCACTATATATTTAATAT

TTTATTATTGTTGTTATTGTTATTATTAATTGGCTTTCTGTATTCTATGCCTTTTATTTA

TAAAGACACTAAGAAAACCCATGTTTGTAATTTTAATAACATTTTTCCCATCTTGTAAT

ATCCAGAGCTACTTTATAAATTCTCTGAACCAAAAGTATTTTCCTCAGTGTATCTCTT

CTCCCCCAGCCCCTATTGGGAAAAATTACCCAGTATAGTTCAGGTTATGAGGAGGA

TCAGCCACACAATCCAGTGCTTCAGTTTGAAAATGTAAAATTCTAACCCTAAAGTAG

GGTTGGTTGAAATTTCAGACAAAGCAAACCCAGCAGGTATAAAAAGTAGTATAAATA

CAAATCTGTAAGTTATTTTTGAATTTTCTGAACTTTTTTCTAAGAGATTACATAGGAG

ACTAAAGAAATCTATCTGTTCAAGTTCTAATTAGGATGATTGTTAATACTGCACTGTG

GATGAAGTGGCGACTGGCTTGTGTGCTGACTTCTGTGGTTTAGCAAGAGGTTTATT

GTTATCAAATGCTAATTGGCAATGCCAAGTCACTGGGACCAATTTTCTGTTTTATAAT

ATCTAAGTTTAGAACAGAATATATACCTGAACTGTAGTGGTTTGATCGGATGGAGAC

AGAAAACCCGATTTTTATTCTCATAAATTTTGTGGTTATTTATACAAGGGCTGTGCTA

TGCTACCATATTCTTGTTCAATAATAATAGGTTTGTTGTTTTTTTTACATTGTTAAATG

TTCCTTACCCCTAAAGGTCAATGTTAAGTACAACATTCTGAAAATACAATTTGGCTAC

GAAGAGTATTCATCTTCTTTGAAGCTCAGTGGTTGATATTTGTGCTAATAATGCAATT

TCCTGATTACTGTTACAAGTTATAGCTACATATGGGAGAGACTCAGTGAGCCAGCAA

AGGCCATAGAAACAACAATTTATTAAATGTATTTATGGCAGAAGGACCTAAATAAAC

TGTGAGCCACCTTTTCTTCTTTATATTGTTACATTTAAGTGTTCTTGCTTTCAGCAAC

TCACATTAATGCTTGGAGCTTATCTCTTTCTCTCTCTCTCTCTCTCTCTGTGTGTG

TGTGTGTATGTGTGTGTGTGTGTGTGTGTGTTTCCTTATTGTCATTCCATTATATATC

CACACCAACATGGGTGACGATAATTCAAAGTCATATTTTGCCTCTAAGCTTGATCAT

GTTACCTTTATGATTAAAGTATCATGTTATTTAGCCAATGCAAATCTGTTTTAAAACA

AATAGTTTAAAAAAAGAACAAGTTTTTAAGGGCTTTATTATAGAAGAAGTATTAATGA

AGGACTTTCCTTCCTCCCTCCCTTTCCTCCCCTCCCTGCCTCCCTTCTTCCCTTCCA

TCTCCCCCTCCTCCCTGCCTTCTTTGTTTCTCCTTCCCTTATTCCTCCCTCCCTCCTT

TCTCCCTTCCTTCCTTTCTTCCATTCATCCTTCCTTGCCTTTTATTTTTATTTTTTGTA

ATATCACATGTGCTGTAGTTTGGAATTTTATTCTAGTGCATTTCTTGCTCATCAGAAC

CTCAGCTAATCTACCTAGGAAAAATAGTATCAAAGGAAATGAGAAAGTTGTATCTGA

GTCCCTCCAGAACTAAGATAATTCTTTTTGACCATTTAAGCCTTTATAAATGCGTTTT

GACCATTTAAGCCTTTATAAATGCTTGTTTTAGGAAAGTGAATCTGTTAGATGCATCA

ACAAATAATGACCAGGACAAAACGATTTAATAATTAAAGTCTCAAATCACCATGGTTA

TACATTTTCACCAGAAATAGTAATCTTACAATTTTTCATTTTTCTGATGAAGATTTCTG

TTCCAATATCTGTTTCCTAATAGATTTTTTAAATTAATTAGCTTTCCTCTGCTTTATGA

CCACAGGTTTTATCCCTAACCGAGACAGCTGTCTTATATCTGCATGCCTTAGACTGT

GTGGAGGGACTCCATGAAGAAAGACCATAGGTTAGAAAAATAACTCATAGTATATAC

-continued

CCTAGTAAGTGGGTTAGTAGAATCTCATAACATGTATTAAAAAGAGGTTTTCTTCTCT

GCTTGTTTGTGTCACTAGAGCAAAATTGTAGAGATAATGCTCATAATGCAGTAAATA

TCAGAATAATATCTACAATATCATTTGTGGATGGTCCCAGGTCCCAGTGCTCTAGTT

ACTTTACTTCTTTTTTTTTTTTTGAGATGGAGTCTTGCTCTGTCTCTCAGGCTAGAGC

AGTGTGCGATCTCAGCTCACTGCAGCCTCCACCTCCCAGGTTCAAGCGATTCTCCT

GCCTCAGCCTCCCAAGTAGCCAGGATTACAGGCACCCTCCACTAGGCCCGGCTAA

TTTTTTTTGTATTTTTTTAGTAGAGATGGGGTTTTGCCATGTTGGCCAGGCTGGTTTC

GAACTCCTAACCTCCAGTGATCCACCTGCCTCGGCGTCCCAAAGTGCTAGGATTAC

AGGCATGAGCCACCACATCCGGCCTAATTACTTCTTTAATCCCCATTTATTTTTATG

CCATTCTAGCCTCATTTATTAATAAAATTATGTTTTTACTTTCTCTTTCAGGAAATTTT

TTAAATTAATATTTTATATCTAGATCTAATGCTATGGAAAAGTGCCTTTTTATCATTTA

TAATTTCATTTTTCACTATTTCCAAAAACACATAAACAAATAGTTTCAGTAGGTCCCA

GCTTTTACTTTTTCCATTTAAACCTTCTTTTCTCCATTTCTTCCCTTTGGCTTAAGAAT

AAAAGAAAAGGTACATTGCTAGAATTGTTTCTTTGGGAGAGGGTAAAAGATTACAGA

ATTAGACTGTTCAGCCTTTATATAAACTAAATTTGTCTTCATCTCAACCAGCTAATGG

TAGGTCTTATCTGAATACTCATGAGAATTTTAGCATCTGTGAAACTCCATGCACCAG

ATGTGTGTAAATTTCAGGAAGAAAGTGTTGAAAGCATTTTCTCTGATGTTAATTAGAT

GGAAATAAATCACTAAAACATAGTTTAGGTAAAGCCTGATTATGCCACTTTTTTTTAA

CTAGACAGGGCAAAGTTGTTTATGTTAGTGTACTTCTTGTCTATCCTCAGTTAATTTA

CCTAGACAAAAAGTGTCAAAGGAAATGAGAAAAAGGTTATATCTGACTCCCTCCAGA

CCTAAGATAATTCCTTTGATCAGATACAGTCAGATGGAGTGCCTTGGTTTTTGTTAA

TTTTGCCTCTATTCCAGCTCCTTACCACAGCGGTGGTGCTTAAAGAAAGGATCATCA

GCAACAGGTCAGGATAGTTCTACCTTTGGGATAGGGCTGCTTTCCCCGTGCTAGTA

TTTCTGTGACTGTTAGTGGCACTGAGGACTGCAAACTTTTATGCAATATTCTTAATAC

CCTATTGATATTATGCACTTTAATCATTCCAAAGAAGCCAAGAATGCTGTATAGTGAT

GATTCCTTCCTAATGAATTCATCTTAACTATTTAGAATGTTATGTCCCTTTTCTTTTGG

ATAGCCAACTTGGTATAAATGTTATATGGATTTTTCTAAAATGACTATATAGGACTTA

AGACTTTGAAATGTAATTTACTTATAAGGGGAAATAATTATGCTTTAGCACATCATTT

TAGAAACGTCACATTTTAGAAACATTCAGCTTGCTAACCTACATGTTTGGGAATTCAT

TAAAACCAGTTGTCTATATATTTTGTGCCATGTATATAAGAACATTACAATATATCTTT

TTCTACATATGTAGTATGTGCAACCAGTGGTTCTCAGAGTATGGTTCTCAGCCCACC

AGCTAGTATCAGTATCACCTGGGAACTAGTTAGAAATGTAAATTCTTTGGCCCCATC

CCAGACATACTGAGTCAGAAACTCTGGAATAGGGCCCCCGCAATCTGTTTTCACAA

GCCCTCCAGGTGATTCTGATGCACACTTTAAAGTTTAGGAACCACTGGGCTAAGAC

TCTGTTGAGATATAGAGTTTTTCTTCCACTCAGACTGATATAGTTATACATTGTTCTT

CATGTAAATTCAGCTTAACCTGGTTATCTATAATCTTTTATTGGCAAAAGTTAATTCT

CAGTACTGCCTATAGAGATACAGTGTATTTTATGTACATACACAATTAGTCTAATTCT

TGATAATTCAGTTAATTTAGTTTGGCATTTTCCTACCACTTACTAAAAGGTTTACATTA

AATGACTGATTTAAATATATAGGTGCAATGTTCTATGTTTATTTTAATTGTTATGACAT

TTAAGTAGCTAATATAATTGACCGGTGCTAAAGTCTCCTGTTTATCCATAAAATGGG

TACATTATGGGCAGTGTAATACAAGCTTTCTTTTCATTGCCTAGTACTTTACCAGCA

-continued

```
GACCACAGTTTTGCCCTGGCTAGACCAACCCTCAGAACAAAATCATCATTCCTTGTA
TTTATATTTGTATCTGAGATAGTAAACAAGATGGCTGGCCAGGTCAACATGGCACCT
TAACTTATTTTTTTAATAGGTAAAACTTCTTCAAAAGTAGCTTGCTTTGTATAAGAACT
AAGCTATCAGTATAGATATAGCTATCCTTGGAGCTTATGTTTCAGACAAGAATTATTT
ACTAAAATAAATAATAAACAAGATAATGCATTATACAATTTGGGCATTTCTCGTTTCT
CAAGTGTATGCATCATGGTAAATATAAACTAACCACAAGATAGGTAGATTGATTCAT
TTCATTTTAATCTCCTTGTGTAATTCAGTACCTCCATAATTGTTCTAATCTTCTTCCCA
CTGTTTACAAATTACCAGTTAATTAACTCGTGAAAGAAAAATTCACATATCAGAATAA
AAATAAATGTATACTCACTTTATAAAAATCACCACTGCTGTCTTTCCTTAATACTAGC
AGTGGAAATGTAAGTGGCTTACTCTACAAATTTTGGTGCTGGCAAATACATAGGCAA
ACTGTTGGGAGCTGCTCTAGTTACATTCCTCCCTTCTTATTCCCTTTTTCTCTTCCTC
ACTTTATTGCATAACATATTCCTGTACCCAAAGCATTCTACCACAGTTCTATTTGACT
CCCACTTGTAATAACTCCTTTAAAAAATTCCATGTTTAACCATATGACCCTGCTTGCT
TACTCATATTCTCCCTCCCTCTCCCCTTCCTTTCTCTCTCTTCCAGAAGTCATTTGCC
TGGTTTGAAATATTTTGTAGGGATTGCTTATTATATTATTTTAGCTGATGAACCTCAG
GACAACGTCTACACACACACACATACATACACGCACACAAAATCTCAGCTGTTGAA
GAGTGGGCTTGGAATCAGACTTCTGTGTCCAGTAAAAAACTCCTGCACTGAAGTCA
TTGTGACTTGAGTAGTTACAGACTGATTCCAGTGAACTTGATCTAATTTCTTTTGATC
TAATGAATGTGTCTGCTTACCTTGTTTCCTTTTAATTGATAAGCTCCAAGTAGTTGCT
AATTTTTTGACAACTTTAAATGAGTTTCATTCACTTCTTTTACTTAATGTTTTAAGTAT
AGTACCAATAATTTCATTAACCTGTTCTCAAGTGGTTTAGCTACCATTCTGCCATTTT
TAATTTTTATTTAATTTTATTTGCTTGAGCACACTGATCAACCACTGAACTGCCTTCTT
CCATTGTCCTGCAATGATATAAGGGTTACATTTTTGTGTATATGGCTTTCATAGTTGG
GATTTCAGAGCACTGATACCAGATATTTTCAGTTTGTTCTCTGGGGGAATTTCATTT
GCATCTATGTTTTTAGCTATCTGTGATAACTTGTTAAATATTAAAAAGATATTTTGCTT
CTATTGGAACATTTGTATACTCGCAACTATATTTCTGTAAACAGCTGCAGTCAAAAAT
AAAACACTGAAAGTTTTCA,
```

or a nucleic acid sequence that hybridizes to a nucleic acid sequence consisting of SEQ ID NO:286 under stringent hybridization conditions In some embodiments, BCL6 transcription repressor (BCL6, BCL5, LAZ3, BCL6A, ZNF51, ZBTB27) comprises the amino acid sequence:

```
                              (SEQ ID NO: 287; NP_001124317.1)
MASPADSCIQFTRHASDVLLNLNRLRSRDILTDVVIVVSREQFRAHKTVL
MACSGLFYSIFTDQLKCNLSVINLDPEINPEGFCILLDFMYTSRLNLREG
NIMAVMATAMYLQMEHVVDTCRKFIKASEAEMVSAIKPPREEFLNSRMLM
PQDIMAYRGREVVENNLPLRSAPGCESRAFAPSLYSGLSTPPASYSMYSH
LPVSSLLFSDEEFRDVRMPVANPFPKERALPCDSARPVPGEYSRPTLEVS
PNVCHSNIYSPKETIPEEARSDMHYSVAEGLKPAAPSARNAPYFPCDKAS
KEEERPSSEDEIALHFEPPNAPLNRKGLVSPQSPQKSDCQPNSPTESCSS
```

-continued

```
KNACILQASGSPPAKSPTDPKACNWKKYKFIVLNSLNQNAKPEGPEQAEL
GRLSPRAYTAPPACQPPMEPENLDLQSPTKLSASGEDSTIPQASRLNNIV
NRSMTGSPRSSSESHSPLYMHPPKCTSCGSQSPQHAEMCLHTAGPTFPEE
MGETQSEYSDSSCENGAFFCNECDCRFSEEASLKRHTLQTHSDKPYKCDR
CQASFRYKGNLASHKTVHTGEKPYRCNICGAQFNRPANLKTHTRIHSGEK
PYKCETCGARFVQVAHLRAHVLIHTGEKPYPCEICGTRFRHLQTLKSHLR
IHTGEKPYHCEKCNLHFRHKSQLRLHLRQKHGAITNTKVQYRVSATDLPP
ELPKAC,
```

or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:287)

In some embodiments, the nucleic acid sequence encoding BCL6 comprises the nucleic acid sequence:

(SEQ ID NO: 288; NM_001130845.2)

ACAAGCGAGCTGGTGGTTGAAGCTGGTTAAAGAACAGCCTAGGTATTCCAGAAGTG

TTTGAGGATCCCTTCCATGAAGGAAGAGAGGAAAGTTTTTAAGTAAACCTCCCACTC

CCATGTGTCTTCAGCTTTCTTTTGCAAAGGAGAAAATCCTTGAAGTTTGGTAAAGAC

CGAGTTAGTCTATCTCTCTTTGCCTATCTCGAGTTGGGCTGGGGAGAGGAGGAGAT

AGGTTCTTTTGTCTTTTTCTGTCTTCTCCCTTCCCCACTTCCTTCCCTCCAGTCCCCA

CTCACTCACATGCACACACTAACCTTGGAGCCGATGGGATTGAGTGACTGGCACTT

GGGACCACAGAGAAATGTCAGAGTGTTTGGTTACAGACTCAAGGAAACCTCTCATT

TTAGAGTGCTCATTTGGTTTTGAGCAAAATTTTGGACTGTGAAGCAAGGCATTGGTG

AAGACAAAATGGCCTCGCCGGCTGACAGCTGTATCCAGTTCACCCGCCATGCCAG

TGATGTTCTTCTCAACCTTAATCGTCTCCGGAGTCGAGACATCTTGACTGATGTTGT

CATTGTTGTGAGCCGTGAGCAGTTTAGAGCCCATAAAACGGTCCTCATGGCCTGCA

GTGGCCTGTTCTATAGCATCTTTACAGACCAGTTGAAATGCAACCTTAGTGTGATCA

ATCTAGATCCTGAGATCAACCCTGAGGGATTCTGCATCCTCCTGGACTTCATGTACA

CATCTCGGCTCAATTTGCGGGAGGGCAACATCATGGCTGTGATGGCCACGGCTAT

GTACCTGCAGATGGAGCATGTTGTGGACACTTGCCGGAAGTTTATTAAGGCCAGTG

AAGCAGAGATGGTTTCTGCCATCAAGCCTCCTCGTGAAGAGTTCCTCAACAGCCGG

ATGCTGATGCCCCAAGACATCATGGCCTATCGGGGTCGTGAGGTGGTGGAGAACA

ACCTGCCACTGAGGAGCGCCCCTGGGTGTGAGAGCAGAGCCTTTGCCCCCAGCCT

GTACAGTGGCCTGTCCACACCGCCAGCCTCTTATTCCATGTACAGCCACCTCCCTG

TCAGCAGCCTCCTCTTCTCCGATGAGGAGTTTCGGGATGTCCGGATGCCTGTGGC

CAACCCCTTCCCCAAGGAGCGGGCACTCCCATGTGATAGTGCCAGGCCAGTCCCT

GGTGAGTACAGCCGGCCGACTTTGGAGGTGTCCCCCAATGTGTGCCACAGCAATA

TCTATTCACCCAAGGAAACAATCCCAGAAGAGGCACGAAGTGATATGCACTACAGT

GTGGCTGAGGGCCTCAAACCTGCTGCCCCCTCAGCCCGAAATGCCCCCTACTTCC

CTTGTGACAAGGCCAGCAAAGAAGAAGAGAGACCCTCCTCGGAAGATGAGATTGC

CCTGCATTTCGAGCCCCCCAATGCACCCCTGAACCGGAAGGGTCTGGTTAGTCCA

CAGAGCCCCCAGAAATCTGACTGCCAGCCCAACTCGCCCACAGAGTCCTGCAGCA

GTAAGAATGCCTGCATCCTCCAGGCTTCTGGCTCCCCTCCAGCCAAGAGCCCCACT

GACCCCAAAGCCTGCAACTGGAAGAAATACAAGTTCATCGTGCTCAACAGCCTCAA

CCAGAATGCCAAACCAGAGGGGCCTGAGCAGGCTGAGCTGGGCCGCCTTTCCCCA

CGAGCCTACACGGCCCCACCTGCCTGCCAGCCACCCATGGAGCCTGAGAACCTTG

ACCTCCAGTCCCCAACCAAGCTGAGTGCCAGCGGGGAGGACTCCACCATCCCACA

AGCCAGCCGGCTCAATAACATCGTTAACAGGTCCATGACGGGCTCTCCCCGCAGC

AGCAGCGAGAGCCACTCACCACTCTACATGCACCCCCCGAAGTGCACGTCCTGCG

GCTCTCAGTCCCCACAGCATGCAGAGATGTGCCTCCACACCGCTGGCCCCACGTT

CCCTGAGGAGATGGGAGAGACCCAGTCTGAGTACTCAGATTCTAGCTGTGAGAAC

GGGGCCTTCTTCTGCAATGAGTGTGACTGCCGCTTCTCTGAGGAGGCCTCACTCAA

GAGGCACACGCTGCAGACCCACAGTGACAAACCCTACAAGTGTGACCGCTGCCAG

GCCTCCTTCCGCTACAAGGGCAACCTCGCCAGCCACAAGACCGTCCATACCGGTG

-continued

AGAAACCCTATCGTTGCAACATCTGTGGGGCCCAGTTCAACCGGCCAGCCAACCT
GAAAACCCACACTCGAATTCACTCTGGAGAGAAGCCCTACAAATGCGAAACCTGCG
GAGCCAGATTTGTACAGGTGGCCCACCTCCGTGCCCATGTGCTTATCCACACTGGT
GAGAAGCCCTATCCCTGTGAAATCTGTGGCACCCGTTTCCGGCACCTTCAGACTCT
GAAGAGCCACCTGCGAATCCACACAGGAGAGAAACCTTACCATTGTGAGAAGTGTA
ACCTGCATTTCCGTCACAAAAGCCAGCTGCGACTTCACTTGCGCCAGAAGCATGGC
GCCATCACCAACACCAAGGTGCAATACCGCGTGTCAGCCACTGACCTGCCTCCGG
AGCTCCCCAAAGCCTGCTGAAGCATGGAGTGTTGATGCTTTCGTCTCCAGCCCCTT
CTCAGAATCTACCCAAAGGATACTGTAACACTTTACAATGTTCATCCCATGATGTAG
TGCCTCTTTCATCCACTAGTGCAAATCATAGCTGGGGGTTGGGGGTGGTGGGGGT
CGGGGCCTGGGGGACTGGGAGCCGCAGCAGCTCCCCCTCCCCCACTGCCATAAA
ACATTAAGAAAATCATATTGCTTCTTCTCCTATGTGTAAGGTGAACCATGTCAGCAA
AAAGCAAAATCATTTTATATGTCAAAGCAGGGGAGTATGCAAAAGTTCTGACTTGAC
TTTAGTCTGCAAAATGAGGAATGTATATGTTTTGTGGGAACAGATGTTTCTTTTGTAT
GTAAATGTGCATTCTTTTAAAAGACAAGACTTCAGTATGTTGTCAAAGAGAGGGCTT
TAATTTTTTTAACCAAAGGTGAAGGAATATATGGCAGAGTTGTAAATATATAAATATA
TATATATATAAAATAAATATATATAAACCTAAAAAAGATATATTAAAAATATAAAACTG
CGTTAAAGGCTCGATTTTGTATCTGCAGGCAGACACGGATCTGAGAATCTTTATTGA
GAAAGAGCACTTAAGAGAATATTTTAAGTATTGCATCTGTATAAGTAAGAAAATATTT
TGTCTAAAATGCCTCAGTGTATTTGTATTTTTTTGCAAGTGAAGGTTTACAATTTACA
AAGTGTGTATTAAAAAAAACAAAAAGAACAAAAAAATCTGCAGAAGGAAAAATGTGT
AATTTTGTTCTAGTTTTCAGTTTGTATATACCCGTACAACGTGTCCTCACGGTGCCTT
TTTTCACGGAAGTTTTCAATGATGGGCGAGCGTGCACCATCCCTTTTTGAAGTGTAG
GCAGACACAGGGACTTGAAGTTGTTACTAACTAAACTCTCTTTGGGAATGTTTGTCT
CATCCCATTCTGCGTCATGCTTGTGTTATAACTACTCCGGAGACAGGGTTTGGCTG
TGTCTAAACTGCATTACCGCGTTGTAAAATATAGCTGTACAAATATAAGAATAAAATG
TTGAAAAGTCAAA, or a nucleic acid sequence that hybridizes to a nucleic acid sequence consisting of SEQ ID NO:288 under stringent hybridization conditions In some embodiments, myogenic differentiation 1 (MYOD1, PUM, MYF3, MYOD, bHLHc1) comprises the amino acid sequence:

(SEQ ID NO: 289; NP_002469.2)

MELLSPPLRDVDLTAPDGSLCSFATTDDFYDDPCFDSPDLRFFEDLDPRL
MHVGALLKPEEHSHFPAAVHPAPGAREDEHVRAPSGHHQAGRCLLWACKA
CKRKTTNADRRKAATMRERRRLSKVNEAFETLKRCTSSNPNQRLPKVEIL
RNAIRYIEGLQALLRDQDAAPPGAAAAFYAPGPLPPGRGGEHYSGDSDAS
SPRSNCSDGMMDYSGPPSGARRRNCYEGAYYNEAPSEPRPGKSAAVSSLD
CLSSIVERISTESPAAPALLLADVPSESPPRRQEAAAPSEGESSGDPTQS
PDAAPQCPAGANPNPIYQVL, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:289)

In some embodiments, the nucleic acid sequence encoding MYOD comprises the nucleic acid sequence:

(SEQ ID NO: 290; NM_002478.5)

AGGGGTGAGGAAGCCCTGGGGCGCTGCCGCCGCTTTCCTTAACCACAAAT
CAGGCCGGACAGGAGAGGGAGGGGTGGGGGACAGTGGGTGGGCATTCAGA
CTGCCAGCACTTTGCTATCTACAGCCGGGGCTCCCGAGCGGCAGAAAGTT
CCGGCCACTCTCTGCCGCTTGGGTTGGGCGAAGCCAGGACCGTGCCGCGC
CACCGCCAGGATATGGAGCTACTGTCGCCACCGCTCCGCGACGTAGACCT
GACGGCCCCCGACGGCTCTCTCTGCTCCTTTGCCACAACGGACGACTTCT
ATGACGACCCGTGTTTCGACTCCCCGGACCTGCGCTTCTTCGAAGACCTG

-continued

GACCCGCGCCTGATGCACGTGGGCGCGCTCCTGAAACCCGAAGAGCACTC
GCACTTCCCCGCGGCGGTGCACCCGGCCCCGGGCGCACGTGAGGACGAGC
ATGTGCGCGCGCCCAGCGGGCACCACCAGGCGGGCCGCTGCCTACTGTGG
GCCTGCAAGGCGTGCAAGCGCAAGACCACCAACGCCGACCGCCGCAAGGC
CGCCACCATGCGCGAGCGGCGCCGCCTGAGCAAAGTAAATGAGGCCTTTG
AGACACTCAAGCGCTGCACGTCGAGCAATCCAAACCAGCGGTTGCCCAAG
GTGGAGATCCTGCGCAACGCCATCCGCTATATCGAGGGCCTGCAGGCTCT
GCTGCGCGACCAGGACGCCGCGCCCCCTGGCGCCGCAGCCGCCTTCTATG
CGCCGGGCCCGCTGCCCCCGGGCCGCGGCGGCGAGCACTACAGCGGCGAC
TCCGACGCGTCCAGCCCGCGCTCCAACTGCTCCGACGGCATGATGGACTA
CAGCGGCCCCCCGAGCGGCGCCCGGCGGCGGAACTGCTACGAAGGCGCCT
ACTACAACGAGGCGCCCAGCGAACCCAGGCCCGGGAAGAGTGCGGCGGTG
TCGAGCCTAGACTGCCTGTCCAGCATCGTGGAGCGCATCTCCACCGAGAG
CCCTGCGGCGCCCGCCCTCCTGCTGGCGGACGTGCCTTCTGAGTCGCCTC
CGCGCAGGCAAGAGGCTGCCGCCCCCAGCGAGGGAGAGAGCAGCGGCGAC
CCCACCCAGTCACCGGACGCCGCCCCGCAGTGCCCTGCGGGTGCGAACCC
CAACCCGATATACCAGGTGCTCTGAGGGGATGGTGGCCGCCCACCCGCCC
GAGGGATGGTGCCCCTAGGGTCCCTCGCGCCCAAAAGATTGAACTTAAAT
GCCCCCCTCCCAACAGCGCTTTAAAAGCGACCTCTCTTGAGGTAGGAGAG
GCGGGAGAACTGAAGTTTCCGCCCCCGCCCCACAGGGCAAGGACACAGCG
CGGTTTTTTCCACGCAGCACCCTTCTCGGAGACCCATTGCGATGGCCGCT
CCGTGTTCCTCGGTGGGCCAGAGCTGAACCTTGAGGGGCTAGGTTCAGCT
TTCTCGCGCCCTCCCCCATGGGGGTGAGACCCTCGCAGACCTAAGCCCTG
CCCCGGGATGCACCGGTTATTTGGGGGGGCGTGAGACCCAGTGCACTCCG
GTCCCAAATGTAGCAGGTGTAACCGTAACCCACCCCCAACCCGTTTCCCG
GTTCAGGACCACTTTTTGTAATACTTTTGTAATCTATTCCTGTAAATAAG
AGTTGCTTTGCCAGAGCAGGAGCCCCTGGGGCTGTATTTATCTCTGAGGC
ATGGTGTGTGGTGCTACAGGGAATTTGTACGTTTATACCGCAGGCGGGCG
AGCCGCGGGCGCTCGCTCAGGTGATCAAAATAAAGGCGCTAATTTATACC
GCC, or a nucleic acid sequence that hybridizes to a nucleic acid sequence consisting of SEQ ID NO:290 under stringent hybridization conditions In some embodiments, myogenic factor 5 (MYF5, EORVA, bHLHc2) comprises the amino acid sequence:

(SEQ ID NO: 291; NP_005584.2)
MDVMDGCQFSPSEYFYDGSCIPSPEGEFGDEFVPRVAAFGAHKAELQGSDE
DEHVRAPTGHHQAGHCLMWACKACKRKSTTMDRRKAATMRERRRLKKVNQA
FETLKRCTTTNPNQRLPKVEILRNAIRYIESLQELLREQVENYYSLPGQSC
SEPTSPTSNCSDGMPECNSPVWSRKSSTFDSIYCPDVSNVYATDKNSLSSL
DCLSNIVDRITSSEQPGLPLQDLASLSPVASTDSQPATPGASSSRLIYHV
L, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:291)

In some embodiments, the nucleic acid sequence encoding MYF5 comprises the nucleic acid sequence:

(SEQ ID NO: 292; NM_005593.3)
ACCCAGGCCAACAGGCGTCTGCCCTTGTTAATTACCGGAGCGACAGACTAG
GGAGCTCCGCCCGGGATTTGCCCATCGGCGGAGGCGCCAGGCTCCCGTTTC
TCCCCATCCCTCTCGCTGCCGTCCAGGTGCACCGCCTGCCTCTCAGCAGGA
TGGACGTGATGGATGGCTGCCAGTTCTCACCTTCTGAGTACTTCTACGACG
GCTCCTGCATACCGTCCCCCGAGGGTGAATTTGGGGACGAGTTTGTGCCGC
GAGTGGCTGCCTTCGGAGCGCACAAAGCAGAGCTGCAGGGCTCAGATGAGG
ACGAGCACGTGCGAGCGCCTACCGGCCACCACCAGGCTGGTCACTGCCTCA
TGTGGGCCTGCAAAGCCTGCAAGAGGAAGTCCACCACCATGGATCGGCGGA
AGGCAGCCACTATGCGCGAGCGGAGGCGCCTGAAGAAGGTCAACCAGGCTT
TCGAAACCCTCAAGAGGTGTACCACGACCAACCCCAACCAGAGGCTGCCCA
AGGTGGAGATCCTCAGGAATGCCATCCGCTACATCGAGAGCCTGCAGGAGT
TGCTGAGAGAGCAGGTGGAGAACTACTATAGCCTGCCGGGACAGAGCTGCT
CGGAGCCCACCAGCCCCACCTCCAACTGCTCTGATGGCATGCCCGAATGTA
ACAGTCCTGTCTGGTCCAGAAAGAGCAGTACTTTTGACAGCATCTACTGTC
CTGATGTATCAAATGTATATGCCACAGATAAAAACTCCTTATCCAGCTTGG
ATTGCTTATCCAACATAGTGGACCGGATCACCTCCTCAGAGCAACCTGGGT
TGCCTCTCCAGGATCTGGCTTCTCTCTCTCCAGTTGCCAGCACCGATTCAC
AGCCTGCAACTCCAGGGGCTTCTAGTTCCAGGCTTATCTATCATGTGCTAT
GAACTAATTTTCTGGTCTATATGACTTCTTCCAGGAGGGCCTAATACACAG
GAAGAAGAAGGCTTCAAAAAGTCCCAAACCAAGACAACATGTACATAAAGA
TTTCTTTTCAGTTGTAAATTTGTAAAGATTACCTTGCCACTTTATAAGAAA
GTGTATTTAACTAAAAAGTCATCATTGCAAATAATACTTTCTTCTTCTTTA
TTATTCTTTGCTTAGATATTAATACATAGTTCCAGTAATACTATTTCTGAT
AGGGGGCCATTGATTGAGGGTAGCTTGTTGCAATGCTTAACTTATATATAC
ATATATATATATTATAAATATTGCTCATCAAAATGTCTCTGGTGTTTAGAG
CTTTATTTTTTTCTTTAAAACATTAAAACAGCTGAGAATCAGTTAAATGGA
ATTTTAAATATATTTAACTATTTCTTTTCTCTTTAATCCTTTAGTTATATT
GTATTAAATAAAAATATAATACTGCCTAATGTATATATTTTGATCTTTTCT
TGTAAGAAATGTATCTTTTAAATGTAAGCACAAAATAGTACTTTGTGGATC
ATTTCAAGATATAAGAAATTTTGGAAATTCCACCATAAATAAAATTTTTTA
CTACAAGAAA, or a nucleic acid sequence that hybridizes to a nucleic acid sequence consisting of SEQ ID NO:292 under stringent hybridization conditions In some embodiments, myogenin (MYOG, MYF5, bHLHc3) comprises the amino acid sequence:

(SEQ ID NO: 293; NP_002470.2)

MELYETSPYFYQEPRFYDGENYLPVHLQGFEPPGYERTELTLSPEAPGPLE

DKGLGTPEHCPGQCLPWACKVCKRKSVSVDRRRAATLREKRRLKKVNEAFE

ALKRSTLLNPNQRLPKVEILRSAIQYIERLQALLSSLNQEERDLRYRGGGG

PQPGVPSECSSHSASCSPEWGSALEFSANPGDHLLTADPTDAHNLHSLTSI

VDSITVEDVSVAFPDETMPN, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:293)

In some embodiments, the nucleic acid sequence encoding MYOG comprises the nucleic acid sequence:

(SEQ ID NO: 294; NM_002479.6)

GGGCTGCTGGAGCTTGGGGGCTGGTGGCAGGAACAAGCCTTTTCCGACCCC

ATGGAGCTGTATGAGACATCCCCCTACTTCTACCAGGAACCCCGCTTCTAT

GATGGGGAAAACTACCTGCCTGTCCACCTCCAGGGCTTCGAACCACCAGGC

TACGAGCGGACGGAGCTCACCCTGAGCCCCGAGGCCCCAGGGCCCCTTGAG

GACAAGGGGCTGGGGACCCCCGAGCACTGTCCAGGCCAGTGCCTGCCGTGG

GCGTGTAAGGTGTGTAAGAGGAAGTCGGTGTCCGTGGACCGGCGGCGGGCG

GCCACACTGAGGGAGAAGCGCAGGCTCAAGAAGGTGAATGAGGCCTTCGAG

GCCCTGAAGAGAAGCACCCTGCTCAACCCCAACCAGCGGCTGCCCAAGGTG

GAGATCCTGCGCAGTGCCATCCAGTACATCGAGCGCCTCCAGGCCCTGCTC

AGCTCCCTCAACCAGGAGGAGCGTGACCTCCGCTACCGGGGCGGGGGCGGG

CCCCAGCCAGGGGTGCCCAGCGAATGCAGCTCTCACAGCGCCTCCTGCAGT

CCAGAGTGGGGCAGTGCACTGGAGTTCAGCGCCAACCCAGGGGATCATCTG

CTCACGGCTGACCCTACAGATGCCCACAACCTGCACTCCCTCACCTCCATC

GTGGACAGCATCACAGTGGAAGATGTGTCTGTGGCCTTCCCAGATGAAACC

ATGCCCAACTGAGATTGTCTTCCAAGCCGGGCATCCTTGCGAGCCCCCCAA

GCTGGCCACAGATGCCACTACTTCTGTAGCAGGGGCCTCCTAAGCCAGGCT

GCCCTGATGCTAGGAAGCCAGCTCTGGGGTGCCATAGGCCAGACTATCCCC

TTCCTCATCCATGTAAGGTTAACCCACCCCCCAGCAAGGGACTGGACGCCC

TCATTCAGCTGCCTCCTTAGAGGAGAGGGCATCCCCTTTCCAGGGAGGTAA

AGCAGGGGACCAGAGCGCCCCCTCGTGTATGCCCCAGCTCAGGGGGCAAAC

TCAGGAGCTTCCTTTTTATCATAACGCGGCCTCTAATTCCACCCCCCAAGT

GAAACGGTTTGAGAGACGCAGTGCCCTGACCTGGACAAGCTGTGCACGTCT

CCTGTTCTGGTCTCTTCCCGATGCCAGTGGCTGGGCTGGGCCTGCCCTGAA

TTGAGAGAGAAGAAGGGGAGAGGAACAGCCCTCTGTTCCCAAGTCCCTGGG

GGGCCAAACTTTTGCAGTGAATATTGGGAACCTTCCAGTGGTTTTATGTTT

TGTTTTGTTTCGTGTGTTGTTTGTAAAGCTGCCATCCGACCAAGGTCTCCT

GTGCTGAAGTTGCCGGGGACAGGCAGGGAAAAGGGGTTGGGGCCTCTTGGG

-continued

GGTGATTTCTTTTGTTAACAAAGCATTGTGTGGTTTTGCCATTGTTTTGTA

TTTTTTTTTTTTTTTTTTTTTTTTGCTAACTTATTTGGATTTCCTTTTTTA

AAAAATGAATAAAGACTGGTTGCCAGAA, or a nucleic acid sequence that hybridizes to a nucleic acid sequence consisting of SEQ ID NO:294 under stringent hybridization conditions In some embodiments, Spi-1 proto-oncogene (SPI1, OF, PU.1, SFPI1, SPI-A) comprises the amino acid sequence:

(SEQ ID NO: 295; NP_001074016.1)

MLQACKMEGFPLVPPQPSEDLVPYDTDLYQRQTHEYYPYLSSDGESHSDHY

WDFHPHHVHSEFESFAENNFTELQSVQPPQLQQLYRHMELEQMHVLDTPMV

PPHPSLGHQVSYLPRMCLQYPSLSPAQPSSDEEEGERQSPPLEVSDGEADG

LEPGPGLLPGETGSKKKIRLYQFLLDLLRSGDMKDSIWWVDKDKGTFQFSS

KHKEALAHRWGIQKGNRKKMTYQKMARALRNYGKTGEVKKVKKKLTYQFSG

EVLGRGGLAERRHPPH, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:295)

In some embodiments, the nucleic acid sequence encoding PU.1 comprises the nucleic acid sequence:

(SEQ ID NO: 296; NM_001080547.2)

AAAATCAGGAACTTGTGCTGGCCCTGCAATGTCAAGGGAGGGGGCTCACCC

AGGGCTCCTGTAGCTCAGGGGGCAGGCCTGAGCCCTGCACCCGCCCCACGA

CCGTCCAGCCCCTGACGGGGCACCCCATCCTGAGGGGCTCTGCATTGGCCC

CCACCGAGGCAGGGGATCTGACCGACTCGGAGCCCGGCTGGATGTTACAGG

CGTGCAAAATGGAAGGGTTTCCCCTCGTCCCCCCTCAGCCATCAGAAGACC

TGGTGCCCTATGACACGGATCTATACCAACGCCAAACGCACGAGTATTACC

CCTATCTCAGCAGTGATGGGGAGAGCCATAGCGACCATTACTGGGACTTCC

ACCCCCACCACGTGCACAGCGAGTTCGAGAGCTTCGCCGAGAACAACTTCA

CGGAGCTCCAGAGCGTGCAGCCCCCGCAGCTGCAGCAGCTCTACCGCCACA

TGGAGCTGGAGCAGATGCACGTCCTCGATACCCCCATGGTGCCACCCCATC

CCAGTCTTGGCCACCAGGTCTCCTACCTGCCCCGGATGTGCCTCCAGTACC

CATCCCTGTCCCCAGCCCAGCCCAGCTCAGATGAGGAGGAGGGCGAGCGGC

AGAGCCCCCCACTGGAGGTGTCTGACGGCGAGGCGGATGGCCTGGAGCCCG

GGCCTGGGCTCCTGCCTGGGGAGACAGGCAGCAAGAAGAAGATCCGCCTGT

ACCAGTTCCTGTTGGACCTGCTCCGCAGCGGCGACATGAAGGACAGCATCT

GGTGGGTGGACAAGGACAAGGGCACCTTCCAGTTCTCGTCCAAGCACAAGG

AGGCGCTGGCGCACCGCTGGGGCATCCAGAAGGGCAACCGCAAGAAGATGA

CCTACCAGAAGATGGCGCGCGCGCTGCGCAACTACGGCAAGACGGGCGAGG

TCAAGAAGGTGAAGAAGAAGCTCACCTACCAGTTCAGCGGCGAAGTGCTGG

GCCGCGGGGGCCTGGCCGAGCGGCGCCACCCGCCCCACTGAGCCCGCAGCC

CCCGCCGGGCCCCGCCAGGCCTCCCCGCTGGCCATAGCATTAAGCCCTCGC

-continued

CCGGCCCGGACACAGGGAGGACGCTCCCGGGGCCCAGAGGCAGGACTGTGG

CGGGCCGGGCCTCGCCTCACCCGCCCCCTCCCCCCACTCCAGGCCCCCTCC

ACATCCCGCTTCGCCTCCCTCCAGGACTCCACCCCGGCTCCCGGACGCCAG

CTGGGCGTCAGACCCCACCGGGGCAACCTTGCAGAGGACGACCCGGGGTAC

TGCCTTGGGAGTCTCAAGTCCGTATGTAAATCAGATCTCCCCTCTCACCCC

TCCCACCCATTAACCTCCTCCCAAAAAACAAGTAAAGTTATTCTCAATCC

A, or a nucleic acid sequence that hybridizes to a nucleic acid sequence consisting of SEQ ID NO:296 under stringent hybridization conditions In some embodiments, colony stimulating factor 1 receptor (CSF1R, FMS, CSFR, FIM2, HDLS, CD115, CSF-1R, BANDDOS, M-CSF-R) comprises the amino acid sequence:

(SEQ ID NO: 297; NP_001275634.1)

MGPGVLLLLLVATAWHGQGIPVIEPSVPELVVKPGATVTLRCVGNGSVEWD

GPPSPHWTLYSDGSSSILSTNNATFQNTGTYRCTEPGDPLGGSAAIHLYVK

DPARPWNVLAQEVVVFEDQDALLPCLLTDPVLEAGVSLVRVRGRPLMRHTN

YSFSPWHGFTIHRAKFIQSQDYQCSALMGGRKVMSISIRLKVQKVIPGPPA

LTLVPAELVRIRGEAAQIVCSASSVDVNFDVFLQHNNTKLAIPQQSDFHNN

RYQKVLTLNLDQVDFQHAGNYSCVASNVQGKHSTSMFFRVVESAYLNLSSE

QNLIQEVTVGEGLNLKVMVEAYPGLQGFNWTYLGPFSDHQPEPKLANATTK

DTYRHTFTLSLPRLKPSEAGRYSFLARNPGGWRALTFELTLRYPPEVSVIW

TFINGSGTLLCAASGYPQPNVTWLQCSGHTDRCDEAQVLQVWDDPYPEVLS

QEPFHKVTVQSLLTVETLEHNQTYECRAHNSVGSGSWAFIPISAGAHTHPP

DEFLFTPVVVACMSIMALLLLLLLLLLYKYKQKPKYQVRWKIIESYEGNSY

TFIDPTQLPYNEKWEFPRNNLQFGKTLGAGAFGKVVEATAFGLGKEDAVLK

VAVKMLKSTAHADEKEALMSELKIMSHLGQHENIVNLLGACTHGGPVLVIT

EYCCYGDLLNFLRRKAEAMLGPSLSPGQDPEGGVDYKNIHLEKKYVRRDSG

FSSQGVDTYVEMRPVSTSSNDSFSEQDLDKEDGRPLELRDLLHFSSQVAQG

MAFLASKNCIHRDVAARNVLLTNGHVAKIGDFGLARDIMNDSNYIVKGNAR

LPVKWMAPESIFDCVYTVQSDVWSYGILLWEIFSLGLNPYPGILVNSKFYK

LVKDGYQMAQPAFAPKNIYSIMQACWALEPTHRPTFQQICSFLQEQAQEDR

RERDYTNLPSSSRSGGSGSSSSELEEESSSEHLTCCEQGDIAQPLLQPNNY

QFC, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:297)

In some embodiments, the nucleic acid sequence encoding CSFR comprises the nucleic acid sequence:

(SEQ ID NO: 298; NM_001288705.3)

AAACAGCCAGTGCAGAGGAGAGGAACGTGTGTCCAGTGTCCCGATCCCTGC

GGAGCTAGTAGCTGAGAGCTCTGTGCCCTGGGCACCTTGCAGCCCTGCACC

-continued

TGCCTGCCACTTCCCCACCGAGGCCATGGGCCCAGGAGTTCTGCTGCTCCT

GCTGGTGGCCACAGCTTGGCATGGTCAGGGAATCCCAGTGATAGAGCCCAG

TGTCCCTGAGCTGGTCGTGAAGCCAGGAGCAACGGTGACCTTGCGATGTGT

GGGCAATGGCAGCGTGGAATGGGATGGCCCCCCATCACCTCACTGGACCCT

GTACTCTGATGGCTCCAGCAGCATCCTCAGCACCAACAACGCTACCTTCCA

AAACACGGGGACCTATCGCTGCACTGAGCCTGGAGACCCCCTGGGAGGCAG

CGCCGCCATCCACCTCTATGTCAAAGACCCTGCCCGGCCCTGGAACGTGCT

AGCACAGGAGGTGGTCGTGTTCGAGGACCAGGACGCACTACTGCCCTGTCT

GCTCACAGACCCGGTGCTGGAAGCAGGCGTCTCGCTGGTGCGTGTGCGTGG

CCGGCCCCTCATGCGCCACACCAACTACTCCTTCTCGCCCTGGCATGGCTT

CACCATCCACAGGGCCAAGTTCATTCAGAGCCAGGACTATCAATGCAGTGC

CCTGATGGGTGGCAGGAAGGTGATGTCCATCAGCATCCGGCTGAAAGTGCA

GAAAGTCATCCCAGGGCCCCCAGCCTTGACACTGGTGCCTGCAGAGCTGGT

GCGGATTCGAGGGGAGGCTGCCCAGATCGTGTGCTCAGCCAGCAGCGTTGA

TGTTAACTTTGATGTCTTCCTCCAACACAACAACACCAAGCTCGCAATCCC

TCAACAATCTGACTTTCATAATAACCGTTACCAAAAAGTCCTGACCCTCAA

CCTCGATCAAGTAGATTTCCAACATGCCGGCAACTACTCCTGCGTGGCCAG

CAACGTGCAGGGCAAGCACTCCACCTCCATGTTCTTCCGGGTGGTAGAGAG

TGCCTACTTGAACTTGAGCTCTGAGCAGAACCTCATCCAGGAGGTGACCGT

GGGGGAGGGGCTCAACCTCAAAGTCATGGTGGAGGCCTACCCAGGCCTGCA

AGGTTTTAACTGGACCTACCTGGGACCCTTTTCTGACCACCAGCCTGAGCC

CAAGCTTGCTAATGCTACCACCAAGGACACATACAGGCACACCTTCACCCT

CTCTCTGCCCCGCCTGAAGCCCTCTGAGGCTGGCCGCTACTCCTTCCTGGC

CAGAAACCCAGGAGGCTGGAGAGCTCTGACGTTTGAGCTCACCCTTCGATA

CCCCCCAGAGGTAAGCGTCATATGGACATTCATCAACGGCTCTGGCACCCT

TTTGTGTGCTGCCTCTGGGTACCCCCAGCCCAACGTGACATGGCTGCAGTG

CAGTGGCCACACTGATAGGTGTGATGAGGCCCAAGTGCTGCAGGTCTGGGA

TGACCCATACCCTGAGGTCCTGAGCCAGGAGCCCTTCCACAAGGTGACGGT

GCAGAGCCTGCTGACTGTTGAGACCTTAGAGCACAACCAAACCTACGAGTG

CAGGGCCCACAACAGCGTGGGGAGTGGCTCCTGGGCCTTCATACCCATCTC

TGCAGGAGCCCACACGCATCCCCCGGATGAGTTCCTCTTCACACCAGTGGT

GGTCGCCTGCATGTCCATCATGGCCTTGCTGCTGCTGCTGCTCCTGCTGCT

ATTGTACAAGTATAAGCAGAAGCCCAAGTACCAGGTCCGCTGGAAGATCAT

CGAGAGCTATGAGGGCAACAGTTATACTTTCATCGACCCCACGCAGCTGCC

TTACAACGAGAAGTGGGAGTTCCCCCGGAACAACCTGCAGTTTGGTAAGAC

CCTCGGAGCTGGAGCCTTTGGGAAGGTGGTGGAGGCCACGGCCTTTGGTCT

GGGCAAGGAGGATGCTGTCCTGAAGGTGGCTGTGAAGATGCTGAAGTCCAC

GGCCCATGCTGATGAGAAGGAGGCCCTCATGTCCGAGCTGAAGATCATGAG

CCACCTGGGCCAGCACGAGAACATCGTCAACCTTCTGGGAGCCTGTACCCA

TGGAGGCCCTGTACTGGTCATCACGGAGTACTGTTGCTATGGCGACCTGCT

-continued

CAACTTTCTGCGAAGGAAGGCTGAGGCCATGCTGGGACCCAGCCTGAGCCC

CGGCCAGGACCCCGAGGGAGGCGTCGACTATAAGAACATCCACCTCGAGAA

GAAATATGTCCGCAGGGACAGTGGCTTCTCCAGCCAGGGTGTGGACACCTA

TGTGGAGATGAGGCCTGTCTCCACTTCTTCAAATGACTCCTTCTCTGAGCA

AGACCTGGACAAGGAGGATGGACGGCCCCTGGAGCTCCGGGACCTGCTTCA

CTTCTCCAGCCAAGTAGCCCAGGGCATGGCCTTCCTCGCTTCCAAGAATTG

CATCCACCGGGACGTGGCAGCGCGTAACGTGCTGTTGACCAATGGTCATGT

GGCCAAGATTGGGGACTTCGGGCTGGCTAGGGACATCATGAATGACTCCAA

CTACATTGTCAAGGGCAATGCCCGCCTGCCTGTGAAGTGGATGGCCCCAGA

GAGCATCTTTGACTGTGTCTACACGGTTCAGAGCGACGTCTGGTCCTATGG

CATCCTCCTCTGGGAGATCTTCTCACTTGGGCTGAATCCCTACCCTGGCAT

CCTGGTGAACAGCAAGTTCTATAAACTGGTGAAGGATGGATACCAAATGGC

CCAGCCTGCATTTGCCCCAAAGAATATATACAGCATCATGCAGGCCTGCTG

GGCCTTGGAGCCCACCCACAGACCCACCTTCCAGCAGATCTGCTCCTTCCT

TCAGGAGCAGGCCCAAGAGGACAGGAGAGAGCGGGACTATACCAATCTGCC

GAGCAGCAGCAGAAGCGGTGGCAGCGGCAGCAGCAGCAGTGAGCTGGAGGA

GGAGAGCTCTAGTGAGCACCTGACCTGCTGCGAGCAAGGGGATATCGCCCA

GCCCTTGCTGCAGCCCAACAACTATCAGTTCTGCTGAGGAGTTGACGACAG

GGAGTACCACTCTCCCCTCCCACAAACTTCAACTCCTCCATGGATGGGGCG

ACACGGGGAGAACATACAAACTCTGCCTTCGGTCATTTCACTCAACAGCTC

GGCCCAGCTCTGAAACTTGGGAAGGTGAGGGATTCAGGGGAGGTCAGAGGA

TCCCACTTCCTGAGCATGGGCCATCACTGCCAGTCAGGGGCTGGGGGCTGA

GCCCTCACCCCCCCCTCCCCTACTGTTCTCATGGTGTTGGCCTCGTGTTTG

CTATGCCAACTAGTAGAACCTTCTTTCCTAATCCCCTTATCTTCATGGAAA

TGGACTGACTTTATGCCTATGAAGTCCCCAGGAGCTACACTGATACTGAGA

AAACCAGGCTCTTTGGGGCTAGACAGACTGGCAGAGAGTGAGATCTCCCTC

TCTGAGAGGAGCAGCAGATGCTCACAGACCACACTCAGCTCAGGCCCCTTG

GAGCAGGATGGCTCCTCTAAGAATCTCACAGGACCTCTTAGTCTCTGCCCT

ATACGCCGCCTTCACTCCACAGCCTCACCCCTCCCACCCCCATACTGGTAC

TGCTGTAATGAGCCAAGTGGCAGCTAAAAGTTGGGGGTGTTCTGCCCAGTC

CCGTCATTCTGGGCTAGAAGGCAGGGGACCTTGGCATGTGGCTGGCCACAC

CAAGCAGGAAGCACAAACTCCCCCAAGCTGACTCATCCTAACTAACAGTCA

CGCCGTGGGATGTCTCTGTCCACATTAAACTAACAGCATTAATGCA, or a nucleic acid sequence that hybridizes to a nucleic acid sequence consisting of SEQ ID NO:298 under stringent hybridization conditions In some embodiments, serum response factor (SRF, MCMI) comprises the amino acid sequence:

(SEQ ID NO: 299; NP_001278930.1

MITSETGKALIQTCLNSPDSPPRSDPTTDQRMSATGFEETDLTYQVSESDS

SGETKDTLKPAFTVTNLPGTTSTIQTAPSTSTTMQVSSGPSFPITNYLAPV

SASVSPSAVSSANGTVLKSTGSGPVSSGGLMQLPTSFTLMPGGAVAQQVPV

-continued

QAIQVHQAPQQASPSRDSSTDLTQTSSSGTVTLPATIMTSSVPTTVGGHMM

YPSPHAVMYAPTSGLGDGSLTVLNAFSQAPSTMQVSHSQVQEPGGVPQVFL

TASSGTVQIPVSAVQLHQMAVIGQQAGSSSNLTELQVVNLDTAHSTKSE.

or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:299)

In some embodiments, the nucleic acid sequence encoding SRF comprises the nucleic acid sequence:

(SEQ ID NO: 300; NM_001292001.2)

GCAGAGGTGGGAGTGACCGGCGCCAGAGAGGAAGAGGGCCCTTGCTGAGTG

AAGGGGCCTATGAGCTGTCCACGCTGACAGGGACACAGGTGCTGTTGCTGG

TGGCCAGTGAGACAGGCCATGTGTATACCTTTGCCACCCGAAAACTGCAGC

CCATGATCACCAGTGAGACCGGCAAGGCACTGATTCAGACCTGCCTCAACT

CGCCAGACTCTCCACCCCGTTCAGACCCCACAACAGACCAGAGAATGAGTG

CCACTGGCTTTGAAGAGACAGATCTCACCTACCAGGTGTCGGAGTCTGACA

GCAGTGGGGAGACCAAGGACACACTGAAGCCGGCGTTCACAGTCACCAACC

TGCCGGGTACAACCTCCACCATCCAAACAGCACCTAGCACCTCTACCACCA

TGCAAGTCAGCAGCGGCCCCTCCTTTCCCATCACCAACTACCTGGCACCAG

TGTCTGCTAGTGTCAGCCCCAGTGCTGTCAGCAGTGCCAATGGGACTGTGC

TGAAGAGTACAGGCAGCGGCCCTGTCTCCTCTGGGGGCCTTATGCAGCTGC

CTACCAGCTTCACCCTCATGCCTGGTGGGGCAGTGGCCCAGCAGGTCCCAG

TGCAGGCCATTCAAGTGCACCAGGCCCCACAGCAAGCGTCTCCCTCCCGTG

ACAGCAGCACAGACCTCACGCAGACCTCCTCCAGCGGGACAGTGACGCTGC

CCGCCACCATCATGACGTCATCCGTGCCCACAACTGTGGGTGGCCACATGA

TGTACCCTAGCCCGCATGCGGTGATGTATGCCCCCACCTCGGGCCTGGGTG

ATGGCAGCCTCACCGTGCTGAATGCCTTCTCCCAGGCACCATCCACCATGC

AGGTGTCACACAGCCAGGTCCAGGAGCCAGGTGGCGTCCCCCAGGTGTTCC

TGACAGCATCATCTGGGACAGTGCAGATCCCTGTTTCAGCAGTTCAGCTCC

ACCAGATGGCTGTGATAGGGCAGCAGGCCGGGAGCAGCAGCAACCTCACCG

AGCTACAGGTGGTGAACCTGGACACCGCCCACAGCACCAAGAGTGAATGAT

CCGCCCGCCGCCCTGGACAGATGGCCCAAGGGATGGCACCACTTATTTATT

GTTGCCTTTTCACGTTTTCTTTACACACACGTTGACGGGCCGCAGGAGGGA

GGCGGGGAGGAGGAACGGGCAGCCACAGGACTGAGCCCTCTCACTCCAGCC

AAAGAAATGGGCCTGCCTGCCTCCACCCGTCCTCCCTCAGCCTCCCCTTCT

TCCCGCCCCACCTCCCATTTCTGTTGCTGGAGGGGCTGTCCTCCTTCCTGG

GACCCCCTCGCCAGCTTGGCTCGATGTTTGCCATGAGTATTAGCTTACCCA

ATGGGACCGTGCCCCACCTCCCCACACACAGGCCTTCTGTGGGGCTGGGCA

CCGTGTCCTCCTCTGAGGAAGCAGTTGGGGCCCTCTTGCCAGCCTCCTTGC

TGACCCCAGGTCAGCCCTGTGTCTGTCACAGGCTGGGTCAAAAGAGCCCTG

GCTCTGCCCCTCAGGGGGCCAGCTGGGGAGATGGGGGCTTCTTCCTCACAC

-continued

TGCTGTCCTCTCCCCCTTCAGCTCCTGAGTAGCTGGGCCTGTGCACTGGGC

AGGTTCCTGGGGCCGCCTGCCCTGCCTTGCCGCTCCCCTTGGACCTCCAGG

GGCTCCTGGGTTGGAGGGAACCACCAGCGTTCCCTTCTCCCCCTTGTCTTC

CCCCCTCTCCTCCCAGCTGCTTTACTTAAAGTTGATTTTGAACTTTTTATT

TGAGGAGACGAAGTGAAAACAAATCTATAAATATATATTTTTAAAATATTT

AACTTTTTTTTATGGCGTTTTTCTCGTCCCCCTCCCTGCCCAAACTCCCCT

TCCCTGGGGAGCCCTCAGGCTCCCCAGAACTGGCTGGGCCCCTGGGGACAG

AGCCACCCCATGAGCTCGGGGTCCACCAGTGTGTGGGGGAGATTCTGGGTT

TGCCCAGTCCTGGGTTGTTTCCAGGAGAAAGCCGGGGGAGGGGCCCTCAGG

CCATTCCCCAACGGGGTGGGGAGGGTGACCCACAGCTCTGGGCCTCTTTTT

GCCCTTTAGGGCTGTTGCTAGGGAGAGGGAAGAGGGAGACCAAATGTCGGG

GTTGGGGTGGGAGGGCGTCAGGCAGAGGCAACTGACTTCATTTGTGCCACA

CGCATGGGCATTGCAGCCTTGCGCTGTCCCAGGCATGCAGCTGCCTGGGGC

CCAAGTTGCAGTGAGCAGGGTGGGGTCTGGGAGGGGGTGAGAGGCAGGAAT

GGGGGTCAGAAGAAGTGGGAGCAGCTTCTTGGGCTGAGTGCAGCCAAAGGG

GAGCCAGAAATGGGCAGTTCTCCCAGGGAGTGAGCAGCTACTGTAACTTTT

TTAAATTAAGACAAAAAGCCTTGAAGAAAATGACTTTATTTTTCTAAGTGT

AACCTCAGTATTTATGTAATTTGTACAGGGGCCATGCCCCACCCCCCTCCT

CCCCCTTTGGGGTAGACCTTGAGGGTGGGCCAGCATAGGGGGGAGGGTCTT

TTACCCTGTGTCAGAGCCTACCTTCACCACCTATATCCAGAAGGGGAGCTT

TTTCAGAAACAGGGCAGCAGTGGGGTGAAATTTTCTTAACCCCTAAGACTG

CCTTCAGTAGGAACAAGCTGGCTTCTGTGATTAGGTGAAGGGATGGGGGAA

GATTTTATGCACAGCCTAGTTATCAAGGGGATGATTTGCCGACATGTTTGA

GAACCCCCTAACCTCTAACCCTCATTGCTGTCTTGCCCCAGTTTGGGGTGC

CAAGATGGAAGTCACCTTTCTGGGCTTTCTCCTGGAGATAGCTGGGGCTTA

TGGGTGGCTTTCAAGGCTGGGGCATGGCAAATCAGGGGCCAGAGAGCAGGG

GAGCTTGGGACTCAGGTCTGTAACTGCCCAGCCCCTTTTCTCTGCTCTTGT

TTCACTCCACCATCACTCACTCACTCCCCACTCCCCCACCCATGGGGAGGA

GACCTTTGATGAATTCTTCCTCTCCTTCCCACAAAAGACAGACCCAGTGAG

TGAATCAGGCAAAGTGCTTATAATGTGTGTTGTGTGAGCGTGGCCTTGGGA

GGACATGCGTGTGTCAGGGATGAGTTGAGGTGATATTTTTATGTGCAGCGA

CCCTTGGTGTTTCCCTTCCTCGGTGGCTCTGGGGTATGTGTGTGTGGGTGT

GTGCGCCTGAGTGAGTGTGTGTGCTTGAATGTGAGTGTGTATGTCAGTGGT

TTCTACTTCCCCTGGGATGCTGACCCAGGAATAGTGGACATGGTCACAGTC

CTATGTACAGAGCTTTCTTTTGTATTAAAAAAAAATACTCTTTCAATAAAT

GTATCATTTTTGTGCACAGA, or a nucleic acid sequence that hybridizes to a nucleic acid sequence consisting of SEQ ID NO:300 under stringent hybridization conditions In some embodiments, GLI family zinc finger 2 (GLI2, CJS, HPE9, PHS2, THP1, TH P2) comprises the amino acid sequence:

(SEQ ID NO: 301; NP_001358200.1)

METSASATASEKQEAKSGILEAAGFPDPGKKASPLVVAAAAAAAVAAQGVP

QHLLPPFHAPLPIDMRHQEGRYHYEPHSVHGVHGPPALSGSPVISDISLIR

LSPHPAGPGESPFNAPHPYVNPHMEHYLRSVHSSPTLSMISAARGLSPADV

AQEHLKERGLFGLPAPGTTPSDYYHQMTLVAGHPAPYGDLLMQSGGAASAP

HLHDYLNPVDVSRFSSPRVTPRLSRKRALSISPLSDASLDLQRMIRTSPNS

LVAYINNSRSSSAASGSYGHLSAGALSPAFTFPHPINPVAYQQILSQQRGL

GSAFGHTPPLIQPSPTFLAQQPMALTSINATPTQLSSSSNCLSDTNQNKQS

SESAVSSTVNPVAIHKRSKVKTEPEGLRPASPLALTQGQVSGHGSCGCALP

LSQEQLADLKEDLDRDDCKQEAEVVIYETNCHWEDCTKEYDTQEQLVHHIN

NEHIHGEKKEFVCRWQACTREQKPFKAQYMLVVHMRRHTGEKPHKCTFEGC

SKAYSRLENLKTHLRSHTGEKPYVCEHEGCNKAFSNASDRAKHQNRTHSNE

KPYICKIPGCTKRYTDPSSLRKHVKTVHGPDAHVTKKQRNDVHLRTPLLKE

NGDSEAGTEPGGPESTEASSTSQAVEDCLHVRAIKTESSGLCQSSPGAQSS

CSSEPSPLGSAPNNDSGVEMPGTGPGSLGDLTALDDTPPGADTSALAAPSA

GGLQLRKHMTTMHRFEQLKKEKLKSLKDSCSWAGPTPHTRNTKLPPLPGSG

SILENFSGSGGGGPAGLLPNPRLSELSASEVTMLSQLQERRDSSTSTVSSA

YTVSRRSSGISPYFSSRRSSEASPLGAGRPHNASSADSYDPISTDASRRSS

EASQCSGGSGLLNLTPAQQYSLRAKYAAATGGPPPTPLPGLERMSLRTRLA

LLDAPERTLPAGCPRPLGPRRGSDGPTYGHGHAGAAPAFPHEAPGGGARRA

SDPVRRPDALSLPRVQRFHSTHNVNPGPLPPCADRRGLRLQSHPSTDGGLA

RGAYSPRPPSISENVAMEAVAAGVDGAGPEADLGLPEDDLVLPDDVVQYIK

AHASGALDEGTGQVYPTESTGFSDNPRLPSPGLHGQRRMVAADSNVGPSAP

MLGGCQLGFGAPSSLNKNNMPVQWNEVSSGTVDALASQVKPPPFPQGNLAV

VQQKPAFGQYPGYSPQGLQASPGGLDSTQPHLQPRSGAPSQGIPRVNYMQQ

LRQPVAGSQCPGMTTTMSPHACYGQVHPQLSPSTISGALNQFPQSCSNMPA

KPGHLGHPQQTEVAPDPTTMGNRHRELGVPDSALAGVPPPHPVQSYPQQSH

HLAASMSQEGYHQVPSLLPARQPGFMEPQTGPMGVATAGFGLVQPRPPLEP

SPTGRHRGVRAVQQQLAYARATGHAMAAMPSSQETAEAVPKGAMGNMGSVP

PQPPPQDAGGAPDHSMLYYYGQIHMYEQDGGLENLGSCQVMRSQPPQPQAC

QDSIQPQPLPSPGVNQVSSTVDSQLLEAPQIDFDAIMDDGDHSSLFSGALS

PSLLHSLSQNSSRLTTPRNSLTLPSIPAGISNMAVGDMSSMLTSLAEESKF

LNMMT, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:301)

In some embodiments, the nucleic acid sequence encoding GLI2 comprises the nucleic acid sequence:

(SEQ ID NO: 302; NM 001371271.1)

GCTGATGGATTGCAGAAGTGCCGGCGCTTGCCAGCCGAGGCAGCACGGCTC

CGCGGACTTTTTTTCAAACTCCCATCAATGAGACTTCGAGGAGGAGCGGGC

GGCGGCGGCGGCTGCGACTGCGAACGCGGAGGAAGGCCAGGAGCCGCAGGA

GGAGCCGGAGGAAAGAGCTTGGGCCGCGCGGCGCGCCGCAGCCTCGGGGAG

CCGCCTGCTCGCCGGCGGTAGGGGCTGCGCGGCGCCCGCCCGCCTCTCGGT

CCCCTCTCTTGCCTGGCCCGCCCCGCCCCGGCTGGCTGGAGCCCCGGCACA

AGGCAGCCAGCCGAGGGTCGCCGCGCCAGCCAAGGTGGGATGGGGGCCCAC

AGCCACCGCCCGGCGCCCGAGAGGCCACCTGCGTGCTAGAGGCAAACTTTT

GTCTCTCTCGGATTGCCACCCAGGACGATGAGCGGCTGAGATGGAGACGTC

TGCCTCAGCCACTGCCTCCGAGAAGCAAGAAGCCAAAAGTGGGATCCTGGA

GGCCGCTGGCTTCCCCGACCCGGGTAAAAAGGCCTCTCCTTTGGTGGTGGC

TGCAGCGGCAGCAGCAGCGGTAGCTGCCCAAGGAGTGCCGCAGCATCTCTT

GCCACCATTCCATGCGCCCCTACCGATTGACATGCGACACCAGGAAGGAAG

GTACCATTACGAGCCTCATTCTGTCCACGGTGTGCACGGGCCCCCTGCCCT

CAGCGGCAGCCCTGTCATCTCTGACATCTCCTTGATCCGGCTTTCCCCGCA

CCCGGCTGGCCCTGGGGAGTCCCCCTTCAACGCCCCCCACCCGTACGTGAA

CCCCCACATGGAGCACTACCTCCGTTCTGTGCACAGCAGCCCCACGCTCTC

CATGATCTCTGCAGCCAGGGGCCTCAGCCCCGCTGATGTGGCCCAGGAGCA

CCTTAAGGAGAGGGGACTGTTTGGCCTTCCTGCTCCAGGCACCACCCCCTC

AGACTATTACCACCAGATGACCCTCGTGGCAGGCCACCCCGCGCCCTACGG

GGACCTGCTGATGCAGAGCGGGGGCGCTGCCAGCGCACCCCATCTCCACGA

CTACCTCAACCCCGTGGACGTGTCCCGTTTCTCCAGCCCGCGGGTGACGCC

CCGCCTGAGCCGCAAGCGGGCGCTGTCCATCTCCCCACTCTCAGACGCCAG

CCTGGACCTGCAGCGGATGATCCGCACCTCACCCAACTCGCTAGTGGCCTA

CATCAACAACTCCCGAAGCAGCTCGGCGGCCAGCGGTTCCTACGGGCATCT

GTCAGCGGGTGCCCTCAGCCCAGCCTTCACCTTCCCCCACCCCATCAACCC

CGTGGCCTACCAGCAGATTCTGAGCCAGCAGAGGGGTCTGGGGTCAGCCTT

TGGACACACACCACCCCTGATCCAGCCCTCACCCACCTTCCTGGCCCAGCA

GCCCATGGCCCTCACCTCCATCAATGCCACGCCCACCCAGCTCAGCAGCAG

CAGCAACTGTCTGAGTGACACCAACCAGAACAAGCAGAGCAGTGAGTCGGC

CGTCAGCAGCACCGTCAACCCTGTCGCCATTCACAAGCGCAGCAAGGTCAA

GACCGAGCCTGAGGGCCTGCGGCCGGCCTCCCCTCTGGCGCTGACGCAGGG

CCAGGTGTCTGGACACGGCTCATGTGGGTGTGCCCTTCCCCTCTCCCAGGA

GCAGCTGGCTGACCTCAAGGAAGATCTGGACAGGGATGACTGTAAGCAGGA

GGCTGAGGTGGTCATCTATGAGACCAACTGCCACTGGGAAGACTGCACCAA

GGAGTACGACACCCAGGAGCAGCTGGTGCATCACATCAACAACGAGCACAT

CCACGGGGAGAAGAAGGAGTTTGTGTGCCGCTGGCAGGCCTGCACGCGGGA

GCAGAAGCCCTTCAAGGCGCAGTACATGCTGGTGGTGCACATGCGGCGACA

CACGGGCGAGAAGCCCCACAAGTGCACGTTCGAGGGCTGCTCGAAGGCCTA

CTCCCGCCTGGAGAACCTGAAGACACACCTGCGGTCCCACACCGGGGAGAA

GCCATATGTGTGTGAGCACGAGGGCTGCAACAAAGCCTTCTCCAACGCCTC

GGACCGCGCCAAGCACCAGAATCGCACCCACTCCAACGAGAAACCCTACAT

CTGCAAGATCCCAGGCTGCACCAAGAGATACACAGACCCCAGCTCTCTCCG

GAAGCATGTGAAAACGGTCCACGGCCCAGATGCCCACGTCACCAAGAAGCA

GCGCAATGACGTGCACCTCCGCACACCGCTGCTCAAAGAGAATGGGGACAG

TGAGGCCGGCACGGAGCCTGGCGGCCCAGAGAGCACCGAGGCCAGCAGCAC

CAGCCAGGCCGTGGAGGACTGCCTGCACGTCAGAGCCATCAAGACCGAGAG

CTCCGGGCTGTGTCAGTCCAGCCCCGGGGCCCAGTCGTCCTGCAGCAGCGA

GCCCTCTCCTCTGGGCAGTGCCCCCAACAATGACAGTGGCGTGGAGATGCC

GGGGACGGGGCCCGGGAGCCTGGGAGACCTGACGGCACTGGATGACACACC

CCCAGGGGCCGACACCTCAGCCCTGGCTGCCCCCTCCGCTGGTGGCCTCCA

GCTGCGCAAACACATGACCACCATGCACCGGTTCGAGCAGCTCAAGAAGGA

GAAGCTCAAGTCACTCAAGGATTCCTGCTCATGGGCCGGGCCGACTCCACA

CACGCGGAACACCAAGCTGCCTCCCCTCCCGGGAAGTGGCTCCATCCTGGA

AAACTTCAGTGGCAGTGGGGGCGGCGGGCCCGCGGGGCTGCTGCCGAACCC

GCGGCTGTCGGAGCTGTCCGCGAGCGAGGTGACCATGCTGAGCCAGCTGCA

GGAGCGCCGCGACAGCTCCACCAGCACGGTCAGCTCGGCCTACACCGTGAG

CCGCCGCTCCTCCGGCATCTCCCCCTACTTCTCCAGCCGCCGCTCCAGCGA

GGCCTCGCCCCTGGGCGCCGGCCGCCCGCACAACGCGAGCTCCGCTGACTC

CTACGACCCCATCTCCACGGACGCGTCGCGGCGCTCGAGCGAGGCCAGCCA

GTGCAGCGGCGGCTCCGGGCTGCTCAACCTCACGCCGGCGCAGCAGTACAG

CCTGCGGGCCAAGTACGCGGCAGCCACTGGCGGCCCCCCGCCCACTCCGCT

GCCGGGCCTGGAGCGCATGAGCCTGCGGACCAGGCTGGCGCTGCTGGACGC

GCCCGAGCGCACGCTGCCCGCCGGCTGCCCACGCCCACTGGGGCCGCGGCG

TGGCAGCGACGGGCCGACCTATGGCCACGGCCACGCGGGGGCTGCGCCCGC

CTTCCCCCACGAGGCTCCAGGCGGCGGAGCCAGGCGGGCCAGCGACCCTGT

GCGGCGGCCCGATGCCCTGTCCCTGCCGCGGGTGCAGCGCTTCCACAGCAC

CCACAACGTGAACCCCGGCCCGCTGCCGCCCTGTGCCGACAGGCGAGGCCT

CCGCCTGCAGAGCCACCCGAGCACCGACGGCGGCCTGGCCCGCGGCGCCTA

CTCGCCCCGGCCGCCTAGCATCAGCGAGAACGTGGCGATGGAGGCCGTGGC

GGCAGGAGTGGACGGCGCGGGGCCCGAGGCCGACCTGGGGCTGCCGGAGGA

CGACCTGGTGCTTCCAGACGACGTGGTGCAGTACATCAAGGCGCACGCCAG

TGGCGCTCTGGACGAGGGCACCGGGCAGGTGTATCCCACGGAAAGCACTGG

CTTCTCTGACAACCCCAGACTACCCAGCCCGGGGCTGCACGGCCAGCGCAG

GATGGTGGCTGCGGACTCCAACGTGGGCCCCTCCGCCCCTATGCTGGGAGG

ATGCCAGTTAGGCTTTGGGGCGCCCTCCAGCCTGAACAAAAATAACATGCC

TGTGCAGTGGAATGAGGTGAGCTCCGGCACCGTAGACGCCCTGGCCAGCCA

GGTGAAGCCTCCACCCTTTCCTCAGGGCAACCTGGCGGTGGTGCAGCAGAA

GCCTGCCTTTGGCCAGTACCCGGGCTACAGTCCGCAAGGCCTACAGGCTAG

CCCTGGGGGCCTGGACAGCACGCAGCCACACCTGCAGCCCCGCAGCGGAGC

CCCCTCCCAGGGCATCCCCAGGGTAAACTACATGCAGCAGCTGCGACAGCC

AGTGGCAGGCAGCCAGTGTCCTGGCATGACTACCACTATGAGCCCCCATGC

CTGCTATGGCCAAGTCCACCCCCAGCTGAGCCCCAGCACCATCAGTGGGGC

-continued

```
CCTCAACCAGTTCCCCCAATCCTGCAGCAACATGCCAGCCAAGCCAGGGCA
TCTGGGGCACCCTCAGCAGACAGAAGTGGCACCTGACCCCACCACGATGGG
CAATCGCCACAGGGAACTTGGGGTCCCCGATTCAGCCCTGGCTGGAGTGCC
ACCACCTCACCCAGTCCAGAGCTACCCACAGCAGAGCCATCACCTGGCAGC
CTCCATGAGCCAGGAGGGCTACCACCAGGTCCCCAGCCTTCTGCCTGCCCG
CCAGCCTGGCTTCATGGAGCCCCAAACAGGCCCGATGGGGGTGGCTACAGC
AGGCTTTGGCCTAGTGCAGCCCCGGCCTCCCCTCGAGCCCAGCCCCACTGG
CCGCCACCGTGGGGTACGTGCTGTGCAGCAGCAGCTGGCCTACGCCAGGGC
CACAGGCCATGCCATGGCTGCCATGCCGTCCAGTCAGGAAACAGCAGAGGC
TGTGCCCAAGGGAGCGATGGGCAACATGGGGTCGGTGCCTCCCCAGCCGCC
TCCGCAGGACGCAGGTGGGGCCCCGGACCACAGCATGCTCTACTACTACGG
CCAGATCCACATGTACGAACAGGATGGAGGCCTGGAGAACCTCGGGAGCTG
CCAGGTCATGCGGTCCCAGCCACCACAGCCACAGGCCTGTCAGGACAGCAT
CCAGCCCCAGCCCTTGCCCTCACCAGGGGTCAACCAGGTGTCCAGCACTGT
GGACTCCCAGCTCCTGGAGGCCCCCCAGATTGACTTCGATGCCATCATGGA
TGATGGCGATCACTCGAGTTTGTTCTCGGGTGCTCTGAGCCCCAGCCTCCT
CCACAGCCTCTCCCAGAACTCCTCCCGCCTCACCACCCCCCGAAACTCCTT
GACCCTGCCCTCCATCCCCGCAGGCATCAGCAACATGGCTGTCGGGGACAT
GAGCTCCATGCTCACCAGCCTCGCCGAGGAGAGCAAGTTCCTGAACATGAT
GACCTAGAGGCCCGAGCGCCTGGTGCTGAGTGCACCCGGAGGGGTCATCGC
TGCCCAGAGCCTGGGGATTCCAGCTGTCTTGTCTTTTTCCAAAAAAGTGTT
AAATAGGCTTGAGGGGTTGTTGCGCAATGGCCGCTTCAGATGACAGATGTT
GTAAGAGAAGGTTTATGGGCATCCTCTCTGGTCTTTTGGATTATTCCTCAG
AACAATGAAAAAAGTCTCCATAGGACAGGAAGGAATGCAAAACTCATTTAC
ACAGTGCTTTCCAGCCTTTGGTGCTTACAGGACCGCGCTGTTCCGGCTTCT
TCACGGCTGACATTCGGCTAACGAGGGATTACTTTGGCCAAAACCTTTCAA
AGGATATGCAGAAAGATGGTAGGGAGCATTTGGGTTTGAATCTGAATGCTA
TACTGGATACTCTGCTCCGGAAAGATGAGCTTTTTATTCTACTACTTGGAA
GGAAAAGGAATTCCTGGTCCACCTGAATTCCTCTATGAAGCCTAACTCTTG
AGGTCTCTAACATACCTTGTCATAGAGGAAAAGCACAGATTATACCTGGAT
GATTCAGGAGCACATTCTGATTCCAGGTTTGGTAGAGCTGGCTCTTCTACT
CCGTAAAGCCGAGTCTGGGACTGGCAGCCCATCCAAGTGTATATGAATGAA
TAAAGCATCCAAGTATATATGAATGAATAAAGTATGTAAGTATCACCAGAA
AAAGGAAAGAAAAAATGTACTCCTTGGGGCAAGCCCAGAAGCTGCCCTGGC
CTCTCCAGACCGTGTTTACAGTGTTTGCATGTAGAATGTAGCCCTTCCTGA
AAAGAAGACTTGTTTCTAAATACCTCGGGGCTGCTGGAGCCGCTGTGGGTT
AGGGATGGACTGAGGCCTCGAGGAGTGAGGGTGCACCCGGGGCCCAGCCTC
AGGCTGCCCTAGGGATCTCTCAGTAGGAAGAGGAAGTTGCGTGTTTACCCA
ATCCTGTTTCTCCAATGCAACGTCCACCCACTTTACCACCAAAAACTCCAG
GGCCTGACGGCAGCCCGGTCCCCCAGCACTCACCAGCAGCCCAGTGTTCTC
CACCAAGCCACAGTGTGCATGCCTGGTATCCTCCGGATTCCCTTCCTTCTG
```

-continued

```
CCCGCTGAGTCACTGGGCAGAGAATGATGACATGTGTAGGTGGTGTGGTTG
GGGGTGGAAAGGGGAAGGGGTTGATCCTCAGGACTCTGAGGGAGCATCGTT
GAATTTTCCTGTTCAGTGTGACCAAGACCCACCTGGAAATGGAATTTGGAA
CTGGCTTCAGGAGACATCATTCCTGAACACACTGTAGGGTGAATTGGTGCA
TCTTCCCCACCATACACACACACACACACACACACACACACACACACACAC
ACACACCCCAAACCTTTTCATGGGGAATGTGTGGCAACCTTGCCAAACAGC
ACCACTCAGAGTGTGACTCTGACTGTGACCTTGGCCTTAATGAGGAACTTC
TTAGGAGAGTTTGAGGACAAGGCCAACATCGTCATCTGGGCTCGCTGCGTC
CCAGCACATCAAACTCTGTCCAGAGACAAGGCCAACTGCAAATGAAAGCCA
GGGAACATTGCTAAGGGTCTGTGGCTCTGTGGTGGTGTTCATCGCCTTCCT
GAGATAGGATTTCCCTTGCCAGTCCCAACCTGTATATATTCTGTACAGAAG
ACATCCCTGAATATACTGTAGGTGAGTCGTCCAGCCAAATTTATATCTCCA
AAACATTTTTAGCTTTTTCTACATGCTATGAATTGAGATGACATGCTCAAC
TTGTAAATAAGTCTTTTTGTACATTAAAAAAGTAATTTTTTCATAATTTAT
CTTGTCTATCTGCTTCCCCCTTGACAGTAGTTAATGAGAACCTGGGCAGTA
AATTTGGTGCATTCGAGCAGAAATTAGGCTGTATTTTTTCTTAACAGTGTC
AAAATTGACTATCCCGCCTTTGCCAAGAAATGTTTAATGCTGAGGCA,
```

or a nucleic acid sequence that hybridizes to a nucleic acid sequence consisting of SEQ ID NO:302 under stringent hybridization conditions In some embodiments, Sp4 transcription factor (SP4, HF1B, SPR-1) comprises the amino acid sequence:

```
                         (SEQ ID NO: 303; NP_001313471.1)
MATEGGKTSEPENNNKKPKTSGSQDSQPSPLALLAATCSKIGTPGENQAT
GQQQIIIDPSQGLVQLQNQPQQLELVTTQLAGNAWQLVASTPPASKENNV
SQPASSSSSSSSSNNGSASPTKTKSGNSSTPGQFQVIQVQNPSGSVQYQV
IPQLQTVEGQQIQINPTSSSSLQDLQGQIQLISAGNNQAILTAANRTASG
NILAQNLANQTVPVQIRPGVSIPLQLQTLPGTQAQVVTTLPINIGGVTLA
LPVINNVAAGGGTGQVGQPAATADSGTSNGNQLVSTPTNTTTSASTMPES
PSSSTTCTTTASTSLTSSDTLVSSADTGQYASTSASSSERTIEESQTPAA
TESEAQSSSQLQPNGMQNAQDQSNSLQQVQIVGQPILQQIQIQQPQQQII
QAIPPQSFQLQSGQTIQTIQQQPLQNVQLQAVNPTQVLIRAPTLTPSGQI
SWQTVQVQNIQSLSNLQVQNAGLSQQLTITPVSSSGGTTLAQIAPVAVAG
APITLNTAQLASVPNLQTVSVANLGAAGVQVQGVPVTITSVAGQQQGQDG
VKVQQATIAPVTVAVGGIANATIGAVSPDQLTQVHLQQGQQTSDQEVQPG
KRLRRVACSCPNCREGEGRGSNEPGKKKQHICHIEGCGKVYGKTSHLRAH
LRWHTGERPFICNWMFCGKRFTRSDELQRHRRTHTGEKRFECPECSKRFM
RSDHLSKHVKTHQNKKGGGTALAIVTSGELDSSVTEVLGSPRIVTVAAIS
QDSNPATPNVSTNMEEF,
```

or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:303)

In some embodiments, the nucleic acid sequence encoding SP4 comprises the nucleic acid sequence:

(SEQ ID NO: 304; NM_001326542.2)
ACAGCCCAGCGGCGGCCATTCGCGGAAAAAGAGGCAGAGCCTGTGCCAGCTACA

GCCTCCTCCGAGCCACCGCGGGCGGGCGGGACCGGCCTCTCCTCCCGCCTCGCC

CCCACCCCCACCCACCTCTATCCCAGTGTCTCCGTCTGAGGGTTTGTCCTGTTAAT

GCGGGATGAGCGAAGAAGGAGGAGGAGGAGGAGGCGGCAGCGGCAGCGGCGAT

GGCTACAGAAGGAGGGAAAACCTCTGAGCCAGAGAATAACAATAAAAAACCCAAAA

CCTCAGGCTCCCAGGACTCTCAGCCCTCTCCTCTGGCTTTACTGGCAGCTACTTGC

AGCAAAATAGGGACTCCTGGTGAAAATCAAGCAACTGGACAACAACAAATTATTATA

GATCCAAGTCAAGGATTGGTGCAACTTCAAAATCAACCACAACAGCTAGAACTGGT

AACAACGCAACTTGCTGGAAACGCTTGGCAACTTGTTGCCTCCACTCCTCCTGCTT

CAAAAGAGAATAACGTTTCTCAACCAGCCTCTAGTTCGTCTAGTTCTTCCAGCAGTA

ATAACGGGAGTGCATCTCCTACAAAAACTAAATCAGGTAATTCTTCCACCCCTGGTC

AATTTCAAGTCATACAAGTACAAAATCCAAGTGGTAGTGTACAGTACCAAGTAATTC

CACAACTTCAGACAGTGGAAGGTCAACAAATTCAAATCAATCCAACTAGTAGTTCAT

CTCTACAGGATTTGCAGGGTCAAATTCAGCTCATTTCTGCAGGTAATAATCAAGCTA

TACTCACAGCTGCTAACAGGACAGCTTCTGGGAATATTCTTGCTCAAAACCTGGCA

AATCAGACAGTTCCGGTCCAAATTAGACCTGGTGTTTCAATACCACTGCAGTTACAG

ACTCTTCCTGGTACTCAGGCTCAAGTTGTAACAACCCTACCAATTAACATTGGAGGA

GTGACTCTAGCTTTGCCAGTGATAAACAACGTGGCTGCCGGAGGAGGGACTGGGC

AGGTTGGCCAGCCTGCTGCTACTGCTGATAGTGGGACTTCCAATGGGAATCAATTA

GTTTCCACACCCACCAACACCACTACTTCTGCCAGTACTATGCCAGAATCTCCCTCC

TCCTCCACTACCTGCACAACCACTGCTTCAACGTCTTTGACAAGCAGTGACACATTA

GTGAGCTCAGCAGATACTGGCCAGTATGCAAGCACATCAGCCAGTAGTTCTGAACG

CACCATTGAAGAATCTCAAACACCTGCTGCTACTGAGTCTGAAGCCCAGAGCTCCA

GTCAGCTTCAGCCTAATGGAATGCAGAATGCACAGGATCAATCAAATTCTCTTCAGC

AGGTGCAAATTGTAGGCCAACCTATCTTACAGCAGATCCAGATCCAACAGCCTCAG

CAACAGATCATTCAGGCTATTCCACCACAGTCGTTTCAACTCCAGTCAGGGCAGAC

GATTCAGACCATCCAGCAGCAGCCTTTACAGAATGTTCAACTTCAAGCAGTAAATCC

GACTCAGGTGCTTATCAGGGCTCCAACTTTAACACCTTCAGGGCAAATCAGTTGGC

AAACTGTACAGGTTCAGAATATTCAGAGTCTTTCAAATTTGCAAGTTCAGAATGCTG

GGTTATCCCAACAATTAACCATCACCCCAGTGTCTTCAAGTGGTGGCACAACTCTTG

CTCAGATTGCTCCTGTGGCTGTTGCTGGTGCCCCAATAACTTTGAATACTGCCCAG

CTTGCATCAGTGCCTAACCTTCAGACAGTGAGCGTTGCCAACCTGGGTGCTGCAG

GTGTTCAAGTGCAGGGAGTTCCCGTTACAATCACTAGTGTTGCAGGTCAGCAGCAA

GGACAAGATGGAGTAAAAGTCCAGCAAGCTACTATAGCTCCTGTAACTGTAGCAGT

TGGAGGAATTGCTAATGCCACGATAGGTGCTGTTAGTCCTGACCAACTCACACAAG

TGCATTTGCAGCAAGGCCAGCAGACTTCTGATCAAGAGGTACAACCTGGCAAGAG

GCTTCGAAGAGTTGCCTGTTCCTGTCCTAATTGTAGGGAAGGAGAAGGAAGAGGCA

GTAATGAACCAGGAAAAAAGAAGCAGCATATCTGTCATATTGAAGGATGTGGTAAA

GTTTATGGCAAAACATCTCATTTACGAGCACATCTTCGCTGGCATACTGGAGAAAGA

-continued

CCTTTTATATGCAACTGGATGTTTTGTGGCAAAAGATTCACACGGAGTGATGAGCTC

CAGAGACATAGAAGAACCCATACAGGTGAAAAGAGATTTGAATGCCCGGAATGTTC

TAAAAGGTTTATGCGGAGTGATCATCTCTCCAAACATGTCAAAACGCACCAGAATAA

AAAAGGTGGTGGGACAGCTCTTGCCATTGTTACCTCGGGAGAACTGGACTCATCTG

TTACAGAGGTGCTTGGCTCCCCAAGAATTGTCACAGTTGCAGCCATTTCTCAAGATT

CGAATCCAGCAACTCCCAATGTTTCAACCAACATGGAAGAATTCTGAAAAGTTATTT

ATAACAGAGACCTCTAGTGCTGCACTTGTTTACACACCTTTGAAAATCTGGAAATGG

GCTGGTCAAGTGGATTACAGAGTAGGAAATTATGTTTTCATTCTTGGCTTCTTTAAG

TATTCCAGGGTTTGGGGTCAACACGTGAAGTGTTGAATTTTAAAAAATACAAAAAGC

AGACTGATGTACTGGAAACAGAAAAGTATTTCCTCCATACTATAAGTTGTAGTTGTTT

GGAAATATATCACATAACCTTTATACAGAATCTTCCCATCTCTTAATATCATGTGTTA

ACATGTTTAAAAAGACCTTAGTAGTTTGCAGGCTGGACCTTAATTGGACTTATTTTCT

TTGAAAGTACTTTGTTATAAATTCAGTCAGTAATAATTTACGTGTATTCTTTTTCTCTA

TAGCACAGAAAACAGATAGTTAACTGATGATAGGGATAATACTGTATTTCCTTAGCT

TGATTTTTGGAAAATCAACCGAAAATAGTTTGGCCGTCTTTTCTAAATGTTAGAAATT

CTTCAACAGTTGAATTAGGTAAGTTCCAAAACAGTAATCTGAGATGCATCTCAGATC

TTTATTACCACTACATTATAGTAGTGTGTATGCAGACAATCAGTGAAGTCCAATTACT

TTCTCCATTTGGAGACACAAGAGGAACATAGAGTTAAATCTTAGGTTAAATTTTAGG

TTGACACCTTAGGAAAATGCTGGGAAAAAAATGGTTAAAACAAAACTCATCATAGCT

TCAGAAAAAATAAAATGAGGCATCTTAACATGCAATGTTCTAAAGTTAGGATTGATTAT

ATTCCTAACCCTAGGTTGAACCACAAAATTTCATTTAAAATGTTTATATTTGGAAATA

TTTGCATAGAGTGTAAATTGTTCTGTAGTTTCATATTTTGTAAATATGAGTTATGTTG

ACAATGTGCAGAATTCTTTATGCTTTGATGTGGTAGCCAAAGAAAGAATTACACTTTT

TTCCAAGGCCAGCAGAAAATTCTCTTTTAACTACATTGTAATTCTTGTTTTCCTCTAC

TAAAAATTGGCCAGTCCCATTTTATTTCTAGTGCTATGTAAGAAGGTAATTAGGAATT

ATAACACAGTAATGTTTTTATGTTACATCAATAACTGAATTTTCCCTAAAAATTAGCCT

AATATATAATAGATATATTATGAAGCAAAACTTTTATTTTTGAAAAGGCAGAATAATTT

TCAGTGAAGTAAGTGACTAAAGAAAAAAACTATATTATTGTTTATGCAAGGGTCTTAC

AGGAAAGGGTCTTTTTTTTTTTTTTTTTGAGATGGAGTCTCGCTCTCTTGCCCAGGC

TGGAGTGCAATGGCACGATCTCAGCTTACTGCAACCGCCGCCTCCCAGGTTCAAG

CGATTCTCCTGTCTTAGCCTCCTGAGTAGCTGGGATTAACAGGCGCCTGCCACCAT

GCCTGGCTAATTTTTGTATTTTTAGTAGAGACAGGGTTTCGCCATGTTGGCCAGGCT

GGTTTCAAACTCCTGACCTCAGGTGATCTGCCCACCTCGGCCTCCCAGAGTGCTG

GGATTACAGGCATGAGCCACCATGCCCGGCTAGGAAAGGGTCTTACTAGGAAAGA

TGGCCAAAAGTTTCATATGAAAAAAATTGGATTATAAACCAGTAACTTAAATATTAAT

AAGGATATTTTATGTTTTAAAAAAGTATTTACACAGAATCATAATCAGTGAAATTGAC

CATTTGAAAACTAAAAGTTTTTACCTACCTGCTCAATTTATTAACATCATTGCTTTGG

GGACTGTTTGAATATAGGTACGTGTTTTCTTGTGCATTCTCTATAATTTCAGGAAAAG

TACTAATGCGAATTCTCTTCCAAAATTGTGATGTTTCTTGTATTTTTGATGAAGGAGA

AATACTGTAATGATCACTGTTTACACTATGTACACTTTAGGCCAGCCCTTTGTAGCG

-continued

TTATATAAAACTGAAGGTCTTTTGTGCTTTCAGTTTGTATAAAAAAGCTTTGAGATTA

AAGGAAAAAAAAAAATTTTTACACTGTGGTTATAAATTTCAAGTTTCTTAAAGCTTTTGT

AGACTTGTAACAGAGTCTTTAAATTTAAGTTGGATTTTGTAAATTGTTTTGTATATTTT

ATTTAATGTACTCTTAACAACTGATGTATCTGGCTTTAAAACATCAGAATTGGTTTGT

TGTTTTGTTTGGTACAGAGGAGCATTTGGTAGTGTTCATTTTAATTTTATTATATAGG

AGCTGAAACATCAAATATATATTTTATCTATCATTATGCTACACAATCAGTGCTATAA

ATTTTTTTATGCAAAGAAACTTTCTTAATGTTTTAATCATGTTTCCTCAGAGTGACACT

TTTTGTTGTTGTTAATACCAAGTATGAACACTCTGCATCATTATTCCATGAACCAGTT

CTAATGCAAACCTATGTATGTCCATTAGAAATGGAAGTTATTTTTTAATCAACAATGA

GGCCTATTATAAATTTATCAGATGAATCTAGATAGCTTTATAGCATATAAAATATGTT

AATTTGTGTTAGCAGGTGCACATTTCACCACTGAAATTAGAAATATTTTGACAGTCT

GTTCTGCATACCATTCTGAGTCTACTTTTCTGTCTTTAGAAGAATCGTAAATTTCAGT

GTCCTTTATTTGACTCAGTGGGATATAGCTGTTATAAGTAATAGGGCACAGATGTGC

AGTAGAGTCTTGTTTAATGGCATTTCACTGTTCATTCCCTTTACCACCGTTATAAAAC

TTTTCTTTATTGTAATTATCAGTGCAAAGCTATGTATTTATCATGGTAAAACTCCAGT

GTTAGAATAGTTTTTTCTTACAGTATACTTTCTTTGGTTAGGTTTGTGTATGTGTTGC

TGATTACATTAGAACTTGATGTTAAGTCATTTATCACACTCTCATGAGAGCAGTAATA

AAAGTGTGTAATCTAGGAGAAAAAGTTAATTTGTCAAACTTAGATAAGCATGATGTTT

AGGTCCTATTTTTCAATTTTATAACTGTTTTATTGCAACAATATTTGTATTTAAGTCTC

CATTTTAATGCCTTGTGGTGTTTTTTTATGCATGTCACTAAGTTGTCATCCCACATAA

ATTGATGTGCAGCATAGGGTATTAAATCTACATAATGATTTTAAAACAGAAATAGTTG

ATGGTAAAATGTAAATGTTTTGCAAAAATTCCTTATAAAAAGTTTTGTAGTAACATTTC

ACTTGTAAATTTTTTTTGTAAAAAAAAAAAAAATGAAAAAAAAAAGATGAATCCAGAAAA

AAACCTGTTTCCCATATTCTAGAATTTAGACAATTATTCTGCCAGCAAAGCCTCTGG

GGCTGTAATTGACATTTTTACAGTGCTGATTTGTATAAAATTTGTTTTTTTGTGGATTT

GGAAATAAAATCATGTACAAGTTGTTGCCTGCAATAACAATTGCAAGTAACCTATTA

AAAATTCCCTTGAGTTTAACATGTTTCATTTAATTATGTATACTATAAAGCAGCAATAA

ATTATTTGAACTATCAACCTA, or a nucleic acid sequence that hybridizes to a nucleic acid sequence consisting of SEQ ID NO:304 under stringent hybridization conditions In some embodiments, activating transcription factor 2 (ATF2, HB16, CREB2, TREB7, CRE-BP1) comprises the amino acid sequence:

(SEQ ID NO: 305; NP_001243019.1)

MKFKLHVNSARQYKDLWNMSDDKPFLCTAPGCGQRFTNEDHLAVHKHKHE

MTLKFGPARNDSVIVADQTPTPTRFLKNCEEVGLFNELASPFENEFKKAS

EDDIKKMPLDLSPLATPIIRSKIEEPSVVETTHQDSPLPHPESTTSDEKE

VPLAQTAQPTSAIVRPASLQVPNVLLTSSDSSVIIQQAVPSPTSSTVITQ

APSSNRPIVPVPGPFPLLLHLPNGQTMPVAIPASITSSNVHVPAAVPLVR

PVTMVPSVPGIPGPSSPQPVQSEAKMRLKAALTQQHPPVTNGDTVKGHGS

-continued

GLVRTQSEESRPQSLQQPATSTTETPASPAHTTPQTQSTSGRRRRAANED

PDEKRRKFLERNRAAASRCRQKRKVWVQSLEKKAEDLSSLNGQLQSEVTL

LRNEVAQLKQLLLAHKDCPVTAMQKKSGYHTADKDDSSEDISVPSSPHTE

AIQHSSVSTSNGVSSTSKAEAVATSVLTQMADQSTEPALSQIVMAPSSQS

QPSGS, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:305)

In some embodiments, the nucleic acid sequence encoding ATF2 comprises the nucleic acid sequence:

(SEQ ID NO: 306; NM_001256090.2)
GTCAGTCCGATCTCGCGAGAGAGGACGGAAGCCTGTGGGAGCCCGTGGCCTTTAA
AGTGCCGTTCAGCCTTTTCCTCCAGGGGTGCTTTGTAAACACGGCTGTGCTCAGGG
CTCGCGGGTGACCGAAAGGATCATGAACTAGTGACCTGGAAAGGGTACTAGATGG
AAACTTGAGAAAGGACTGCTTATTGATAACAGCTAAGGTATTCCTGGAAGCAGAGTA
AATAAAGCTCATGGCCCACCAGCTAGAAAGATTTCCTGAAGAGGTAGTCTGATTGG
CTTAACTCGTATTCTTGCCATGAGAAAAAGAATGTGATAAGTTATTCAACTTATGAAA
TTCAAGTTACATGTGAATTCTGCCAGGCAATACAAGGACCTGTGGAATATGAGTGAT
GACAAACCCTTTCTATGTACTGCGCCTGGATGTGGCCAGCGTTTTACCAACGAGGA
TCATTTGGCTGTCCATAAACATAAACATGAGATGACACTGAAATTTGGTCCAGCACG
TAATGACAGTGTCATTGTGGCTGATCAGACCCCAACACCAACAAGATTCTTGAAAAA
CTGTGAAGAAGTGGGTTTGTTTAATGAGTTGGCGAGTCCATTTGAGAATGAATTCAA
GAAAGCTTCAGAAGATGACATTAAAAAAATGCCTCTAGATTTATCCCCTCTTGCAAC
ACCTATCATAAGAAGCAAAATTGAGGAGCCTTCTGTTGTAGAAACAACTCACCAGGA
TAGTCCTTTACCTCACCCAGAGTCTACTACCAGTGATGAGAAGGAAGTACCATTGG
CACAAACTGCACAGCCCACATCAGCTATTGTTCGTCCAGCATCATTACAGGTTCCC
AATGTGCTGCTTACAAGTTCTGACTCAAGTGTAATTATTCAGCAGGCAGTACCTTCA
CCAACCTCAAGTACTGTAATCACCCAGGCACCATCCTCTAACAGGCCAATTGTCCC
TGTACCAGGCCCATTTCCTCTTCTGTTACATCTTCCTAATGGACAAACCATGCCTGT
TGCTATTCCTGCATCAATTACAAGTTCTAATGTGCATGTTCCAGCTGCAGTCCCACT
CGTTCGACCAGTCACCATGGTGCCTAGTGTTCCAGGAATCCCAGGTCCTTCCTCTC
CCCAACCAGTACAGTCAGAAGCAAAAATGAGATTAAAAGCTGCTTTGACCCAGCAA
CATCCTCCAGTTACCAATGGTGATACTGTCAAAGGTCATGGTAGCGGATTGGTTAG
GACTCAGTCAGAGGAATCTCGACCGCAGTCATTACAACAGCCAGCCACATCCACTA
CAGAAACTCCGGCTTCTCCAGCTCACACAACTCCACAGACCCAAAGTACAAGTGGT
CGTCGGAGAAGAGCAGCTAACGAAGATCCTGATGAAAAAAGGAGAAAGTTTTTAGA
GCGAAATAGAGCAGCAGCTTCAAGATGCCGACAAAAAAGGAAAGTCTGGGTTCAGT
CTTTAGAGAAGAAAGCTGAAGACTTGAGTTCATTAAATGGTCAGCTGCAGAGTGAA
GTCACCCTGCTGAGAAATGAAGTGGCACAGCTGAAACAGCTTCTTCTGGCTCATAA
AGATTGCCCTGTAACCGCCATGCAGAAGAAATCTGGCTATCATACTGCTGATAAAG
ATGATAGTTCAGAAGACATTTCAGTGCCGAGTAGTCCACATACAGAAGCTATACAG
CATAGTTCGGTCAGCACATCCAATGGAGTCAGTTCAACCTCCAAGGCAGAAGCTGT
AGCCACTTCAGTCCTCACCCAGATGGCGGACCAGAGTACAGAGCCTGCTCTTTCAC
AGATCGTTATGGCTCCTTCCTCCCAGTCACAGCCCTCAGGAAGTTGATTAAAAACCT
GCAGTACAACAGTTTTAGATACTCATTAGTGACTTCAAAGGGAAATCAAGGAAAGAC
CAGTTTCCATTTATGCGAAATCTGTGGTTGTAAATTTTTTTTTTTTACTTGAAATTAAA
TTTGGCTCTAAAGTTGGTGTAGCAGCAGTTGATCAGACTGAAAAACGGTTTTTAGTC
TCTGGAAAAAGACTGATTTTGCTTTTTTTATAAATATTATTAGATTTATTAATTTTTCT
GTGCTCAATGTGTAAATTGTATTATAATTCATTGTGATTTATTTCACTTTTAATTTGCT
GGTGTTTTAATAAATGGGGGTGTTACTGAATCTTTCTTCCCACTTCCATTTCTTTTGA

-continued

CCACCCCTTAACCCTCAACTGTGACGGTAGTAGTATTATCATTTATACCAAAGTTTT

GCATAGTCCCTGTTGACTTTGTAATGTTAACGGAGTCATAAAAGCACTAGGCAAGA

GAAAGATAGAAATTTGCTTTTAATCTTTTTGCCTTTTATTTTGCACATTATGCAAAAG

GAAAAACATTAAAGAACACTTTTTTTTAAGTGAGTGAAAACATGGTAAAGACATACA

GTGCTTTTATGCACATTGTTAAGCTAAATCAAGGTCATTTATAATCATTTTCCTTTTTT

ATTTAAGATTTTAAGTAAACAAATTTTAGAATTTTCAGCATTTCAAAAATGATTTTATT

TTTCAAGTCTTAAATTCAATATTTTACACCTATGTTTTGAGGCTAAAAATATGAAATTA

TATAATGTATGATACAGGGTTATCAAATATCTAATAATTTTTGAAATTAGCTCTTGTTT

TTGGTTTTTTTGTTGTTGTTTTTACAGATTTCAGGTTACAAACTGCAAAGTTTATGCA

TAATTAAGTATGGTATGGTTGCCAGAAAAGCCTAAAATTACTACTTAGAAAATTTAAG

ACTGTTTACCCCCATTGTCTTGTACTTGCGAGCTAACTTGTACTATTCTTGTGAAAG

CACTGTCATCTTTTAGTAGCAAATTTTGATAATGTTTCTCGTGGAAAAAAAAAATCAGT

ATCTATCTTTAGAACAATGTAATTATAATGTGGGAAGTGTGCATGAATGAGAGAGAG

TGTGTGTGTATCTGTGTGTGTGTGCGCGTGTGTGTGTGTCTTTTAATAGTTTATGCC

AGCAATCTTTGCTTGAATGTTTAACGATGCCTTCAGTGTGATGCTGGCCAATAGATG

ATTGCAGTTTAAAATGTCATTATTGTGCAGGCTTGGATAACTAACATTCCATGATGTA

GCTTGTTTCTGATGAGATGATTGTAGGTACATTTTTCTCATTATCCAATCATCTGTGG

GATACTTAGTTTTCTAATGTGCCATTATCTATTTTTATTCTGCAGTTATGTTCAAAATA

CAGTACATATTTTAAAATAGAATAAATTGTTAAACATAAAATTTTAAAAGTAGTAGATG

TGCGTAAGAAAACTTTGTAAAATAGTTATGAGTCCTACCCAGTAGCAACTTCTGGCA

TTCAAGCAGGATTCCACTATGTAAATATCTGTAATGCATTTATAATAAGTTGTGTAGT

TTGTCCTGCATCCATACTACACTATTTGCTAAAGTCTCAGTGCCATCTCCTAATGAG

ACTGACATTTTAAAAGTCTGTATGGAATATCCTTGATAATTCAAGGAAATATCCCTCC

TGCCTAAGTTCCAAACTGGGAAACATTCAAATTATATAAATGACATTTCAGGACTTTA

AGTATGAAGATAATGGGAATTTTATTGTTTTGCTTTTTAAAATGAGAGCATTTTTATTT

GATAATTTTTTTTAAATTTTTAATTTTTAACTAATTTCATTATTTTAAAGTAATCAGTTTT

TCAAATCATGATTTTGATATCATTATTCTAAGGAGTTATCTCAAAGGCACAAAATATG

AATTCTGCAAGAAGGCTATTTTTTATTGTAGTTTGAATGGGTTAGGAAAAGCCTCAA

TTTTTCACTCTTAAGTCCTTCAGTACATTTTTCTTTCATCTTATTACTTATGCAAGTTA

AGGTTCTTTGGTAACAGAATTCTTGCAACTGTAAAATAAAACTACATAGATGTAAGAA

GTCATGTAAACGGTTAACAAGCTTACCAAGGTTAGCAAAACTTTCATTGTAAATCAG

TCTGTACTGAGCAAATAAAAATCATTATTAGTTGTATAAACACAAATTCCATTTTGAC

TTTCAGGATGTCATACTACTTCTGTACCTAGCATTTTCAGTCCTTATATTTGCAATGT

TACACAAACTGTACTATTTTCTTTTATGTGCAGTTTGCATGAGTAAACCATCAGAGAA

TAAATTCTATCTTTAAATTA, or a nucleic acid sequence that hybridizes to a nucleic acid sequence consisting of SEQ ID NO:306 under stringent hybridization conditions In some embodiments, activating transcription factor 3 (ATF3) comprises the amino acid sequence:

(SEQ ID NO: 307; NP_001025458.1)
MMLQHPGQVSASEVSASAIVPCLSPPGSLVFEDFANLTPFVKEELRFAIQ

NKHLCHRMSSALESVTVSDRPLGVSITKAEVAPEEDERKKRRRERNKIAA

AKCRNKKKEKTECLQKESEKLESVNAELKAQIEELKNEKQHLIYMLNLHR

PTCIVRAQNGRTPEDERNLFIQQIKEGTLQS, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:307)

In some embodiments, the nucleic acid sequence encoding ATF3 comprises the nucleic acid sequence:

(SEQ ID NO: 308; NM_001030287.3)
GGCGGAGGTGGGGTTAGCTTCAGTTGACCAACCATGCCTTGAGGATAAAT

TGGATGGGATCAGATGGGAAGATGTGACAAGAAGAGAAATCCTCCTCTAT

ATAGGATGCTCTGCTGTTTCCTAAGGATTTTCAGCACCTTGCCCCAAAAT

CAAAATGATGCTTCAACACCCAGGCCAGGTCTCTGCCTCGGAAGTGAGTG

CTTCTGCCATCGTCCCCTGCCTGTCCCCTCCTGGGTCACTGGTGTTTGAG

GATTTTGCTAACCTGACGCCCTTTGTCAAGGAAGAGCTGAGGTTTGCCAT

CCAGAACAAGCACCTCTGCCACCGGATGTCCTCTGCGCTGGAATCAGTCA

CTGTCAGCGACAGACCCCTCGGGGTGTCCATCACAAAAGCCGAGGTAGCC

CCTGAAGAAGATGAAAGGAAAAAGAGGCGACGAGAAAGAAATAAGATTGC

AGCTGCAAAGTGCCGAAACAAGAAGAAGGAGAAGACGGAGTGCCTGCAGA

AAGAGTCGGAGAAGCTGGAAAGTGTGAATGCTGAACTGAAGGCTCAGATT

GAGGAGCTCAAGAACGAGAAGCAGCATTTGATATACATGCTCAACCTTCA

TCGGCCCACGTGTATTGTCCGGGCTCAGAATGGGAGGACTCCAGAAGATG

AGAGAAACCTCTTTATCCAACAGATAAAAGAAGGAACATTGCAGAGCTAA

GCAGTCGTGGTATGGGGGCGACTGGGGAGTCCTCATTGAATCCTCATTTT

ATACCCAAAACCCTGAAGCCATTGGAGAGCTGTCTTCCTGTGTACCTCTA

GAATCCCAGCAGCAGAGAACCATCAAGGCGGGAGGGCCTGCAGTGATTCA

GCAGGCCCTTCCCATTCTGCCCCAGAGTGGGTCTTGGACCAGGGCAAGTG

CATCTTTGCCTCAACTCCAGGATTTAGGCCTTAACACACTGGCCATTCTT

ATGTTCCAGATGGCCCCCAGCTGGTGTCCTGCCCGCCTTTCATCTGGATT

CTACAAAAAACCAGGATGCCCACCGTTAGGATTCAGGCAGCAGTGTCTGT

ACCTCGGGTGGGAGGGATGGGGCCATCTCCTTCACCGTGGCTACCATTGT

-continued

CACTCGTAGGGGATGTGGAGTGAGAACAGCATTTAGTGAAGTTGTGCAAC

GGCCAGGGTTGTGCTTTCTAGCAAATATGCTGTTATGTCCAGAAATTGTG

TGTGCAAGAAAACTAGGCAATGTACTCTTCCGATGTTTGTGTCACACAAC

ACTGATGTGACTTTTATATGCTTTTTCTCAGATCTGGTTTCTAAGAGTTT

TGGGGGGCGGGGCTGTCACCACGTGCAGTATCTCAAGATATTCAGGTGGC

CAGAAGAGCTTGTCAGCAAGAGGAGGACAGAATTCTCCCAGCGTTAACAC

AAAATCCATGGGCAGTATGATGGCAGGTCCTCTGTTGCAAACTCAGTTCC

AAAGTCACAGGAAGAAAGCAGAAAGTTCAACTTCCAAAGGGTTAGGACTC

TCCACTCAATGTCTTAGGTCAGGAGTTGTGTCTAGGCTGGAAGAGCCAAA

GAATATTCCATTTTCCTTTCCTTGTGGTTGAAAACCACAGTCAGTGGAGA

GATGTTTGGAAACCACAGTCAGTGGAGCCTGGGTGGTACCCAGGCTTTAG

CATTATTGGATGTCAATAGCATTGTTTTTGTCATGTAGCTGTTTTAAGAA

ATCTGGCCCAGGGTGTTTGCAGCTGTGAGAAGTCACTCACACTGGCCACA

AGGACGCTGGCTACTGTCTATTAAAATTCTGATGTTTCTGTGAAATTCTC

AGAGTGTTTAATTGTACTCAATGGTATCATTACAATTTTCTGTAAGAGAA

AATATTACTTATTTATCCTAGTATTCCTAACCTGTCAGAATAATAAATAT

TGGAACCAAGACATGGTAAACAAAAAAAAAAAAAA, or a nucleic acid sequence that hybridizes to a nucleic acid sequence consisting of SEQ ID NO:308 under stringent hybridization conditions In some embodiments, ETS variant transcription factor 5 (ETV5, ERM) comprises the amino acid sequence:

(SEQ ID NO: 309; NP_004445.1)
MDGFYDQQVPFMVPGKSRSEECRGRPVIDRKRKFLDTDLAHDSEELFQDL

SQLQEAWLAEAQVPDDEQFVPDFQSDNLVLHAPPPTKIKRELHSPSSELS

SCSHEQALGANYGEKCLYNYCAYDRKPPSGFKPLTPPTTPLSPTHQNPLF

PPPQATLPTSGHAPAAGPVQGVGPAPAPHSLPEPGPQQQTFAVPRPPHQP

LQMPKMMPENQYPSEQRFQRQLSEPCHPFPPQPGVPGDNRPSYHRQMSEP

IVPAAPPPPQGFKQEYHDPLYEHGVPGMPGPPAHGFQSPMGIKQEPRDYC

VDSEVPNCQSSYMRGGYFSSSHEGFSYEKDPRLYFDDTCVVPERLEGKVK

QEPTMYREGPPYQRRGSLQLWQFLVTLLDDPANAHFIAWTGRGMEFKLIE

PEEVARRWGIQKNRPAMNYDKLSRSLRYYYEKGIMQKVAGERYVYKFVCD

PDALFSMAFPDNQRPFLKAESECHLSEEDTLPLTHFEDSPAYLLDMDRCS

SLPYAEGFAY, or an amino acid sequence that has at least 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:309)

In some embodiments, the nucleic acid sequence encoding ETV5 comprises the nucleic acid sequence:

(SEQ ID NO: 310; NM_004454.3)
AGAGTCCAGCCGCTGGTGCGCGGAGCGGTTCACCGTCTTCGGAGCGGTTCGGCC

CAGCCTTTCGCCCAGGCGCCCAGGCCCGCTGCGCGCGTGCGTGAGCGCGCCTGC

-continued

GCCGCCGGGGCCGCTGCAAGGGGAGGAGAGAGGCCGCCTCAGGAGGATCCCTTT

TCCCCCAGAAATTACTCAATGCTGAAACCTCTCAAAGTGGTATTAGAGACGCTGAAA

GCACCATGGACGGGTTTTATGATCAGCAAGTCCCTTTTATGGTCCCAGGGAAATCT

CGATCTGAGGAATGCAGAGGGCGGCCTGTGATTGACAGAAAGAGGAAGTTTTTGG

ACACAGATCTGGCTCACGATTCTGAAGAGCTATTTCAGGATCTCAGTCAACTTCAAG

AGGCTTGGTTAGCTGAAGCACAAGTTCCTGATGATGAACAGTTTGTCCCAGATTTTC

AGTCTGATAACCTGGTGCTTCATGCCCCACCTCCAACCAAGATCAAACGGGAGCTG

CACAGCCCCTCCTCTGAGCTGTCGTCTTGTAGCCATGAGCAGGCTCTTGGTGCTAA

CTATGGAGAAAAGTGCCTCTACAACTATTGTGCCTATGATAGGAAGCCTCCCTCTG

GGTTCAAGCCATTAACCCCTCCTACAACCCCCCTCTCACCCACCCATCAGAATCCC

CTATTTCCCCCACCTCAGGCAACTCTGCCCACCTCAGGGCATGCCCCTGCAGCTG

GCCCAGTTCAAGGTGTGGGCCCCCGCCCCCGCCCCCCATTCGCTTCCAGAGCCTGG

ACCACAGCAGCAAACATTTGCGGTCCCCCGACCACCACATCAGCCCCTGCAGATG

CCAAAGATGATGCCTGAAAACCAGTATCCATCAGAACAGAGATTTCAGAGACAACT

GTCTGAACCCTGCCACCCCTTCCCTCCTCAGCCAGGAGTTCCTGGAGATAATCGCC

CCAGTTACCATCGGCAAATGTCAGAACCTATTGTCCCTGCAGCTCCCCCGCCCCCT

CAGGGATTCAAACAAGAATACCATGACCCACTCTATGAACATGGGGTCCCGGGCAT

GCCAGGGCCCCCAGCACACGGGTTCCAGTCACCAATGGGAATCAAGCAGGAGCCT

CGGGATTACTGCGTCGATTCAGAAGTGCCTAACTGCCAGTCATCCTACATGAGAGG

GGGTTATTTCTCCAGCAGCCATGAAGGTTTTTCATATGAAAAAGATCCCCGATTATA

CTTTGACGACACTTGTGTTGTGCCTGAGAGACTGGAAGGCAAAGTCAAACAGGAGC

CTACCATGTATCGAGAGGGGCCCCCTTACCAGAGGCGAGGTTCCCTTCAGCTGTG

GCAGTTCCTGGTCACCCTTCTTGATGACCCAGCCAATGCCCACTTCATTGCCTGGA

CAGGTCGAGGCATGGAGTTCAAGCTGATAGAACCGGAAGAGGTTGCTCGGCGCTG

GGGCATCCAGAAGAACCGGCCAGCCATGAACTATGACAAGCTGAGCCGCTCTCTC

CGCTATTACTATGAAAAGGGCATCATGCAGAAGGTGGCTGGAGAGCGATACGTCTA

CAAATTTGTCTGTGACCCAGATGCCCTCTTCTCCATGGCTTTCCCGGATAACCAGC

GTCCGTTCCTGAAGGCAGAGTCCGAGTGCCACCTCAGCGAGGAGGACACCCTGCC

GCTGACCCACTTTGAAGACAGCCCCGCTTACCTCCTGGACATGGACCGCTGCAGC

AGCCTCCCCTATGCCGAAGGCTTTGCTTACTAAGTTTCTGAGTGGCGGAGTGGCCA

AACCCTAGAGCTAGCAGTTCCCATTCAGGCAAACAAGGGCAGTGGTTTTGTTTGTG

TTTTTGGTTGTTCCTAAAGCTTGCCCTTTGAGTATTATCTGGAGAACCCAAGCTGTC

TCTGGATTGGCACCCTTAAAGACAGATACATTGGCTGGGGAGTGGGAACAGGGAG

GGGCAGAAAACCACCAAAAGGCCAGTGCCTCAACTCTTGATTCTGATGAGGTTTCT

GGGAAGAGATCAAAATGGAGTCTCCTTACCATGGACAATACATGCAAAGCAATATC

TTGTTCAGGTTAGTACCCGCAAAACGGGACATAGTATGTGACAATCTGCATCGATC

ATGGACTACTAAATGCCTTTACATAGAAGGGCTCTGATTTGCACAATTTGTTGAAAA

ATCACAAACCCATAGAAAAGTAAGTAGGCTAAGTTGGGGAGGCTCAAACCATTAAG

GGTTAAAAATACATCTTAAACATTGGAAAGCTCTTCTAGCTGAATCTGAAATATTACC

CCTTGTCTAGAAAAAGGGGGGCAGTCAGAACAGCTGTTCCCCACTCCGTGGTTCTC

AAAATCATAAACCATGGCTACTCTTGGGAACCACCCGGCCATGTGGTCGCCAAGTA

-continued

```
GAGCAAGCCCCCTTTCTCTTCCCAATCACGTGGCTGAGTGTGGATGACTTTTATTTT

AGGAGAAGGGCGATTAACACTTTTGACAGTATTTTGTTTTGCCCTGATTTGGGGGAT

TGTTTTGTTTTGGTGGTTGTTTTGGAAAAACAGTTTATAAACTGATTTTTGTAGTTTT

GGTATTTAAAGCAAAAAAACGAAAAACAAAAAACAAAAACAAACCTTTTGGTAACTG

TGCACTGTGTCCTTTAGCCAGGGCCGTGCCAACTTATGAAGACACTGCAGCTTGAG

AGGGGCTTTGCTGAGGCTTCCCCTTGGCCATGTGAAAGCCCGCCTTGTTGCCTGC

TTTGTGCTTTCTGCACCAGACAACCTGATGGAACATTTGCACCTGAGTTGTACATTT

TTGAAGTGTGCAGGGCAGCCTGGACACAAGCTTAGATTCTCTATGTATAGTTCCCC

GTGTTCACTAACATGCCCTCTCTGGAAAGCATATGTATATAACATGTGTCATGTCCT

TTGGAAACCTGGTCACCTGGTGAAAACCCTTGGGATTCTTCCCTGGGCATGACTGA

TGACAATTTCCATTTCATCAGTTTGTTTTGTTTTCCTTTTTCTTTAAATCTTGGACTTT

AAACCCTACCTGTGTGATTCAGTAGGGTTTGAGACTTACGTGTGATACTGACAGGT

AAGCAACAGTGCTAGCATTCTAGATTCCTGCCTTTTTTTAAAAAGAAATTATTCTCAT

TGCTGTATTATATTGGAAAAGTTTTAAACAACCAAGCTAAAGCTATGTGAAAGTTGA

GCTCAAAGTAGAGGAAAAGTTACTGGTGGTACCTTGCTGCCTGCTCTGCTGGTAGA

ATTCTGTGCTCCCCGTGACACTTAGTACATTAAGAATGACTACACTGTTCCTCGTAT

GTGAAGGAGGCAGTGCTGACTCCGTGAGTGTGAGACACGTGCTTTGAACTGCTTTT

CTATTCATGGAGCACTCCATAGTCTCAAACTGTCCCCCTTATGACCAACAGCACATT

TGTGAAGAGGTTCGCAGGGATAAGGGGTGCACTTTATAGCTATGGAAACATGAGAT

TCTCCTCTATTGGAAGCTAATTAGCCCACAAAGGTGGTAAACCTGTAGATTGGGCC

TTAATTAGCATTGTACTCTAATCAAAGGACTCTTTCTAAACCATATTTATAGCTTTCTT

AACCTACACATAGTCTATACATAGATGCATATTTTACCCCCAGCTGGCTAGAGATTT

ATTTGTTGTAAATGCTGTATAGATTTGGTTTTCCTTTCTTTACTTACCCTGGTTTGGA

TTTTTTTTTTTTTTCTTTTGAATGGATTTATGCTGTCTTAGCAATATGACAATAATCCT

CTGTAGCTTGAGCTACCCCTCCCCTGCTGTAACTTACGTGACCTGTGCTGTCACTG

GGCATAGGACAGCGGCATCACGGTTGCATTCCCATTGGACTCATGCACCTCCCGG

ATGGTTTTTGTTTTTTTCGGGGGTTCTTTGGGGTTTGTTTGTTTGCTTCTTTTCCAGA

GTGTGGAAAGTCTACAGTGCAGAAAGGCTTGAACCTGCCAGCTGATTTGAAATACT

TTCCCCTGCGCAGGGCCGTATGCATCCTGCCAAGCTGCGTTATATTCTGTACTGTG

TACAATAAAGAAGTTTGCTTTTCGTTTACCAAGCA,
```

or a nucleic acid sequence that hybridizes to a nucleic acid sequence consisting of SEQ ID NO:310 under stringent hybridization conditions. In order to express a polypeptide or functional nucleic acid, the nucleotide coding sequence may be inserted into appropriate expression vector. Therefore, also disclosed is a non-viral vector comprising a polynucleotide comprising one or more nucleic acid sequences encoding the disclosed transcription factors, wherein the one or more nucleic acid sequences are operably linked to an expression control sequence. In some embodiments, the nucleic acid sequences are operably linked to a single expression control sequence. In other embodiments, the nucleic acid sequences are operably linked to two or more separate expression control sequences. In some embodiments, the non-viral vector comprises a plasmid selected from the group pIRES-hrGFP-21, pAd-IRES-GFP, pCMV6-AC-GFP, and pCDNA3.0.

Methods to construct expression vectors containing genetic sequences and appropriate transcriptional and translational control elements are well known in the art. These methods include in vitro recombinant DNA techniques, synthetic techniques, and in vivo genetic recombination. Such techniques are described in Sambrook et al., Molecular Cloning, A Laboratory Manual (Cold Spring Harbor Press, Plainview, N.Y., 1989), and Ausubel et al., Current Protocols in Molecular Biology (John Wiley & Sons, New York, N.Y., 1989).

Expression vectors generally contain regulatory sequences necessary elements for the translation and/or transcription of the inserted coding sequence. For example, the coding sequence is preferably operably linked to a promoter and/or enhancer to help control the expression of the desired gene product.

The "control elements" or "regulatory sequences" are those non-translated regions of the vector—enhancers, promoters, 5' and 3' untranslated regions—which interact with host cellular proteins to carry out transcription and translation. Such elements may vary in their strength and specificity.

A "promoter" is generally a sequence or sequences of DNA that function when in a relatively fixed location in regard to the transcription start site. A "promoter" contains core elements required for basic interaction of RNA polymerase and transcription factors and can contain upstream elements and response elements.

"Enhancer" generally refers to a sequence of DNA that functions at no fixed distance from the transcription start site and can be either 5' or 3' to the transcription unit. Furthermore, enhancers can be within an intron as well as within the coding sequence itself. They are usually between 10 and 300 bp in length, and they function in cis. Enhancers function to increase transcription from nearby promoters. Enhancers, like promoters, also often contain response elements that mediate the regulation of transcription. Enhancers often determine the regulation of expression.

An "endogenous" enhancer/promoter is one which is naturally linked with a given gene in the genome. An "exogenous" or "heterologous" enhancer/promoter is one which is placed in juxtaposition to a gene by means of genetic manipulation (i.e., molecular biological techniques) such that transcription of that gene is directed by the linked enhancer/promoter.

Promoters used in biotechnology are of different types according to the intended type of control of gene expression. They can be generally divided into constitutive promoters, tissue-specific or development-stage-specific promoters, inducible promoters, and synthetic promoters.

Constitutive promoters direct expression in virtually all tissues and are largely, if not entirely, independent of environmental and developmental factors. As their expression is normally not conditioned by endogenous factors, constitutive promoters are usually active across species and even across kingdoms. Examples of constitutive promoters include CMV, EF1a, SV40, PGK1, Ubc, Human beta actin, and CAG.

Tissue-specific or development-stage-specific promoters direct the expression of a gene in specific tissue(s) or at certain stages of development. For plants, promoter elements that are expressed or affect the expression of genes in the vascular system, photosynthetic tissues, tubers, roots and other vegetative organs, or seeds and other reproductive organs can be found in heterologous systems (e.g. distantly related species or even other kingdoms) but the most specificity is generally achieved with homologous promoters (i.e. from the same species, genus or family). This is probably because the coordinate expression of transcription factors is necessary for regulation of the promoters activity.

The performance of inducible promoters is not conditioned to endogenous factors but to environmental conditions and external stimuli that can be artificially controlled. Within this group, there are promoters modulated by abiotic factors such as light, oxygen levels, heat, cold and wounding. Since some of these factors are difficult to control outside an experimental setting, promoters that respond to chemical compounds, not found naturally in the organism of interest, are of particular interest. Along those lines, promoters that respond to antibiotics, copper, alcohol, steroids, and herbicides, among other compounds, have been adapted and refined to allow the induction of gene activity at will and independently of other biotic or abiotic factors.

The two most commonly used inducible expression systems for research of eukaryote cell biology are named Tet-Off and Tet-On. The Tet-Off system makes use of the tetracycline transactivator (tTA) protein, which is created by fusing one protein, TetR (tetracycline repressor), found in *Escherichia coli* bacteria, with the activation domain of another protein, VP16, found in the Herpes Simplex Virus. The resulting tTA protein is able to bind to DNA at specific TetO operator sequences. In most Tet-Off systems, several repeats of such TetO sequences are placed upstream of a minimal promoter such as the CMV promoter. The entirety of several TetO sequences with a minimal promoter is called a tetracycline response element (TRE), because it responds to binding of the tetracycline transactivator protein tTA by increased expression of the gene or genes downstream of its promoter. In a Tet-Off system, expression of TRE-controlled genes can be repressed by tetracycline and its derivatives. They bind tTA and render it incapable of binding to TRE sequences, thereby preventing transactivation of TRE-controlled genes. A Tet-On system works similarly, but in the opposite fashion. While in a Tet-Off system, tTA is capable of binding the operator only if not bound to tetracycline or one of its derivatives, such as doxycycline, in a Tet-On system, the rtTA protein is capable of binding the operator only if bound by a tetracycline. Thus the introduction of doxycycline to the system initiates the transcription of the genetic product. The Tet-On system is sometimes preferred over Tet-Off for its faster responsiveness.

In some embodiments, the nucleic acid sequences encoding the disclosed transcription factors are operably linked to the same expression control sequence. Alternatively, internal ribosome entry sites (IRES) elements can be used to create multigene, or polycistronic, messages. IRES elements are able to bypass the ribosome scanning model of 5' methylated Cap dependent translation and begin translation at internal sites. IRES elements can be linked to heterologous open reading frames. Multiple open reading frames can be transcribed together, each separated by an IRES, creating polycistronic messages. By virtue of the IRES element, each open reading frame is accessible to ribosomes for efficient translation. Multiple genes can be efficiently expressed using a single promoter/enhancer to transcribe a single message.

Disclosed are non-viral vectors containing one or more polynucleotides disclosed herein operably linked to an expression control sequence. Examples of such non-viral vectors include the oligonucleotide alone or in combination with a suitable protein, polysaccharide or lipid formulation. Non-viral methods present certain advantages over viral methods, with simple large scale production and low host immunogenicity being just two. Previously, low levels of transfection and expression of the gene held non-viral methods at a disadvantage; however, recent advances in vector technology have yielded molecules and techniques with transfection efficiencies similar to those of viruses.

Examples of suitable non-viral vectors include, but are not limited to pIRES-hrGFP-2a, pAd-IRES-GFP, and pCDNA3.0.

The compositions disclosed can be used therapeutically in combination with a pharmaceutically acceptable carrier. By "pharmaceutically acceptable" is meant a material that is not biologically or otherwise undesirable, i.e., the material may be administered to a subject, along with the nucleic acid or vector, without causing any undesirable biological effects or interacting in a deleterious manner with any of the other components of the pharmaceutical composition in which it is contained. The carrier would naturally be selected to minimize any degradation of the active ingredient and to minimize any adverse side effects in the subject, as would be well known to one of skill in the art.

The materials may be in solution, suspension (for example, incorporated into microparticles, liposomes, or cells). These may be targeted to a particular cell type via antibodies, receptors, or receptor ligands. The following references are examples of the use of this technology to target specific proteins to tumor tissue (Senter, et al., Bioconjugate Chem., 2:447-451, (1991); Bagshawe, K. D., Br. J. Cancer, 60:275-281, (1989); Bagshawe, et al., Br. J. Cancer, 58:700-703, (1988); Senter, et al., Bioconjugate Chem., 4:3-9, (1993); Battelli, et al., Cancer Immunol. Immunother., 35:421-425, (1992); Pietersz and McKenzie, Immunolog. Reviews, 129:57-80, (1992); and Roffler, et al., Biochem. Pharmacol, 42:2062-2065, (1991)). Vehicles such as "stealth" and other antibody conjugated liposomes (including lipid mediated drug targeting to colonic carcinoma), receptor mediated targeting of DNA through cell specific ligands, lymphocyte directed tumor targeting, and highly specific therapeutic retroviral targeting of murine glioma cells in vivo. The following references are examples of the use of this technology to target specific proteins to tumor tissue (Hughes et al., Cancer Research, 49:6214-6220, (1989); and Litzinger and Huang, Biochimica et Biophysica Acta, 1104:179-187, (1992)). In general, receptors are involved in pathways of endocytosis, either constitutive or ligand induced. These receptors cluster in clathrin-coated pits, enter the cell via clathrin-coated vesicles, pass through an acidified endosome in which the receptors are sorted, and then either recycle to the cell surface, become stored intracellularly, or are degraded in lysosomes. The internalization pathways serve a variety of functions, such as nutrient uptake, removal of activated proteins, clearance of macromolecules, opportunistic entry of viruses and toxins, dissociation and degradation of ligand, and receptor-level regulation. Many receptors follow more than one intracellular pathway, depending on the cell type, receptor concentration, type of ligand, ligand valency, and ligand concentration. Molecular and cellular mechanisms of receptor-mediated endocytosis has been reviewed (Brown and Greene, DNA and Cell Biology 10:6, 399-409 (1991)).

Suitable carriers and their formulations are described in Remington: The Science and Practice of Pharmacy (19th ed.) ed. A. R. Gennaro, Mack Publishing Company, Easton, PA 1995. Typically, an appropriate amount of a pharmaceutically-acceptable salt is used in the formulation to render the formulation isotonic. Examples of the pharmaceutically-acceptable carrier include, but are not limited to, saline, Ringer's solution and dextrose solution. The pH of the solution is preferably from about 5 to about 8, and more preferably from about 7 to about 7.5. Further carriers include sustained release preparations such as semipermeable matrices of solid hydrophobic polymers containing the antibody, which matrices are in the form of shaped articles, e.g., films, liposomes or microparticles. It will be apparent to those persons skilled in the art that certain carriers may be more preferable depending upon, for instance, the route of administration and concentration of composition being administered.

Pharmaceutical carriers are known to those skilled in the art. These most typically would be standard carriers for administration of drugs to humans, including solutions such as sterile water, saline, and buffered solutions at physiological pH. The compositions can be administered intramuscularly or subcutaneously. Other compounds will be administered according to standard procedures used by those skilled in the art.

Pharmaceutical compositions may include carriers, thickeners, diluents, buffers, preservatives, surface active agents and the like in addition to the molecule of choice. Pharmaceutical compositions may also include one or more active ingredients such as antimicrobial agents, antiinflammatory agents, anesthetics, and the like.

Preparations for parenteral administration include sterile aqueous or non-aqueous solutions, suspensions, and emulsions. Examples of non-aqueous solvents are propylene glycol, polyethylene glycol, vegetable oils such as olive oil, and injectable organic esters such as ethyl oleate. Aqueous carriers include water, alcoholic/aqueous solutions, emulsions or suspensions, including saline and buffered media. Parenteral vehicles include sodium chloride solution, Ringers dextrose, dextrose and sodium chloride, lactated Ringers, or fixed oils. Intravenous vehicles include fluid and nutrient replenishers, electrolyte replenishers (such as those based on Ringers dextrose), and the like. Preservatives and other additives may also be present such as, for example, antimicrobials, anti-oxidants, chelating agents, and inert gases and the like.

Formulations for topical administration may include ointments, lotions, creams, gels, drops, suppositories, sprays, liquids and powders. Conventional pharmaceutical carriers, aqueous, powder or oily bases, thickeners and the like may be necessary or desirable.

Compositions for oral administration include powders or granules, suspensions or solutions in water or non-aqueous media, capsules, sachets, or tablets. Thickeners, flavorings, diluents, emulsifiers, dispersing aids or binders may be desirable.

Some of the compositions may potentially be administered as a pharmaceutically acceptable acid- or base-addition salt, formed by reaction with inorganic acids such as hydrochloric acid, hydrobromic acid, perchloric acid, nitric acid, thiocyanic acid, sulfuric acid, and phosphoric acid, and organic acids such as formic acid, acetic acid, propionic acid, glycolic acid, lactic acid, pyruvic acid, oxalic acid, malonic acid, succinic acid, maleic acid, and fumaric acid, or by reaction with an inorganic base such as sodium hydroxide, ammonium hydroxide, potassium hydroxide, and organic bases such as mono-, di-, trialkyl and aryl amines and substituted ethanolamines.

The herein disclosed compositions, including pharmaceutical composition, may be administered in a number of ways depending on whether local or systemic treatment is desired, and on the area to be treated. For example, the disclosed compositions can be administered intravenously, intraperitoneally, intramuscularly, subcutaneously, intracavity, or transdermally. The compositions may be administered orally, parenterally (e.g., intravenously), by intramuscular injection, by intraperitoneal injection, transdermally, extracorporeally, ophthalmically, vaginally, rectally, intranasally, topically or the like, including topical intranasal administration or administration by inhalant.

Methods

Also disclosed are methods of reprogramming diseased musculoskeletal cells that involve delivering intracellularly into the somatic cells a polynucleotide comprising one or more nucleic acid sequences encoding the disclosed transcription factors. In some embodiments, the nucleic acid sequences are present in non-viral vectors. In some embodiments, the nucleic acid sequences are operably linked to an expression control sequence. In other embodiments the nucleic acids are operably linked to two or more expression control sequences.

A variety of methods are known in the art and suitable for introduction of nucleic acid into a cell, including viral and non-viral mediated techniques. Examples of typical non-viral mediated techniques include, but are not limited to, electroporation, calcium phosphate mediated transfer, nucleofection, sonoporation, heat shock, magnetofection, liposome mediated transfer, microinjection, microprojectile mediated transfer (nanoparticles), cationic polymer mediated transfer (DEAE-dextran, polyethylenimine, polyethylene glycol (PEG) and the like) or cell fusion.

In some embodiments, after transfecting target cells with the disclosed polynucleotides, the cells can then pack the transfected genes (e.g. cDNA) into EVs, which can then induce endothelium in other somatic cells. Therefore, also disclosed is a method of reprogramming diseased musculoskeletal cells that involves exposing the cells with an extracellular vesicle produced from a cell containing or expressing the disclosed transcription factors.

Therefore, disclosed are methods of reprogramming diseased musculoskeletal cells that involve exposing the cells to extracellular vesicles (EVs) isolated from cells expressing or containing exogenous polynucleotides comprising one or more nucleic acid sequences encoding the disclosed transcription factors. For example, in some embodiments, the donor cells are transfected with the one or more disclosed polynucleotides and cultured in vitro. EVs secreted by the donor cells can then collected from the culture medium. These EVs can then be administered to the diseased musculoskeletal to reprogram them into healthy cells. In some embodiments, the donor cells can be any viable musculoskeletal cells or skin cells, including (but not limited to) NP, AF, CEPs, Articular Chondrocytes, tenocytes, and osteoblasts.

Exosomes and microvesicles are EVs that differ based on their process of biogenesis and biophysical properties, including size and surface protein markers. Exosomes are homogenous small particles ranging from 40 to 150 nm in size and they are normally derived from the endocytic recycling pathway. In endocytosis, endocytic vesicles form at the plasma membrane and fuse to form early endosomes. These mature and become late endosomes where intraluminal vesicles bud off into an intra-vesicular lumen. Instead of fusing with the lysosome, these multivesicular bodies directly fuse with the plasma membrane and release exosomes into the extracellular space. Exosome biogenesis, protein cargo sorting, and release involve the endosomal sorting complex required for transport (ESCRT complex) and other associated proteins such as Alix and Tsg101. In contrast, microvesicles, are produced directly through the outward budding and fission of membrane vesicles from the plasma membrane, and hence, their surface markers are largely dependent on the composition of the membrane of origin. Further, they tend to constitute a larger and more heterogeneous population of extracellular vesicles, ranging from 150 to 1000 nm in diameter. However, both types of vesicles have been shown to deliver functional mRNA, miRNA and proteins to recipient cells.

In some embodiments, the polynucleotides are delivered to the somatic cells, or the donor cells for EVs, intracellularly via a gene gun, a microparticle or nanoparticle suitable for such delivery, transfection by electroporation, three-dimensional nanochannel electroporation, a tissue nanotransfection device, a liposome suitable for such delivery, or a deep-topical tissue nanoelectroinjection device. In some embodiments, a viral vector can be used. However, in other embodiments, the polynucleotides are not delivered virally.

Electroporation is a technique in which an electrical field is applied to cells in order to increase permeability of the cell membrane, allowing cargo (e.g., reprogramming factors) to be introduced into cells. Electroporation is a common technique for introducing foreign DNA into cells.

Tissue nanotransfection allows for direct cytosolic delivery of cargo (e.g., reprogramming factors) into cells by applying a highly intense and focused electric field through arrayed nanochannels, which benignly nanoporates the juxtaposing tissue cell members, and electrophoretically drives cargo into the cells.

In one embodiment, the disclosed compositions are administered in a dose equivalent to parenteral administration of about 0.1 ng to about 100 g per kg of body weight, about 10 ng to about 50 g per kg of body weight, about 100 ng to about 1 g per kg of body weight, from about 1 μg to about 100 mg per kg of body weight, from about 1 μg to about 50 mg per kg of body weight, from about 1 mg to about 500 mg per kg of body weight; and from about 1 mg to about 50 mg per kg of body weight. Alternatively, the amount of the disclosed compositions administered to achieve a therapeutic effective dose is about 0.1 ng, 1 ng, 10 ng, 100 ng, 1 μg, 10 μg, 100 μg, 1 mg, 2 mg, 3 mg, 4 mg, 5 mg, 6 mg, 7 mg, 8 mg, 9 mg, 10 mg, 11 mg, 12 mg, 13 mg, 14 mg, 15 mg, 16 mg, 17 mg, 18 mg, 19 mg, 20 mg, 30 mg, 40 mg, 50 mg, 60 mg, 70 mg, 80 mg, 90 mg, 100 mg, 500 mg per kg of body weight or greater.

In some embodiments, the disclosed compositions and methods are used to create a vasculature that can serve as a scaffolding structure. This scaffolding structure can then be used, for example, to aid in the repair of nerve tissue. Applications of this include peripheral nerve injuries, and pathological/injurious insults to the central nervous system such as traumatic brain injury or stroke. In some embodiments, the created vasculature can be used to nourish composite tissue transplants, or any tissue graft.

In some embodiments, the disclosed compositions and methods are used to convert "unwanted" tissue (e.g., fat, scar tissue) into vasculature. Such newly formed vasculature is expected to "resorb" under non-ischemic conditions.

A number of embodiments of the invention have been described. Nevertheless, it will be understood that various modifications may be made without departing from the spirit and scope of the invention. Accordingly, other embodiments are within the scope of the following claims.

EXAMPLES

Example 1: FOXF1 Transfection for Trans-Differentiation of Diseased Intervertebral Disc Cells into a Healthy Phenotype Low back pain affects 70-85% of the world's population and is the leading cause of disability worldwide with over $100 billion in medical expenses in the U.S.A Alone. Intervertebral Disc degeneration is a main contributor of low back pain but current therapies do not target the underlying disease.

Such treatments include surgical interventions and medication which can result in non-unions, nerve injuries, ect. Some proposed treatments include tissue engineering, cell therapy, and even injectable hydrogel constructs. However, those treatments are under desired by clinicians and lack mechanical integrity of the IVD.

A native healthy IVD is gelatinous in the middle (Nucleus Pulposus) with surrounding fibers (Annulus Fibrosus). It's the largest avascular organ in the body. However, with aging, increased mechanical loads, and unknown disease pathologies, the disc degenerates. This degeneration has shown to cause pain due to pressure on the spinal cord along with unwarranted neurovascular invasion.

Figure 1B:
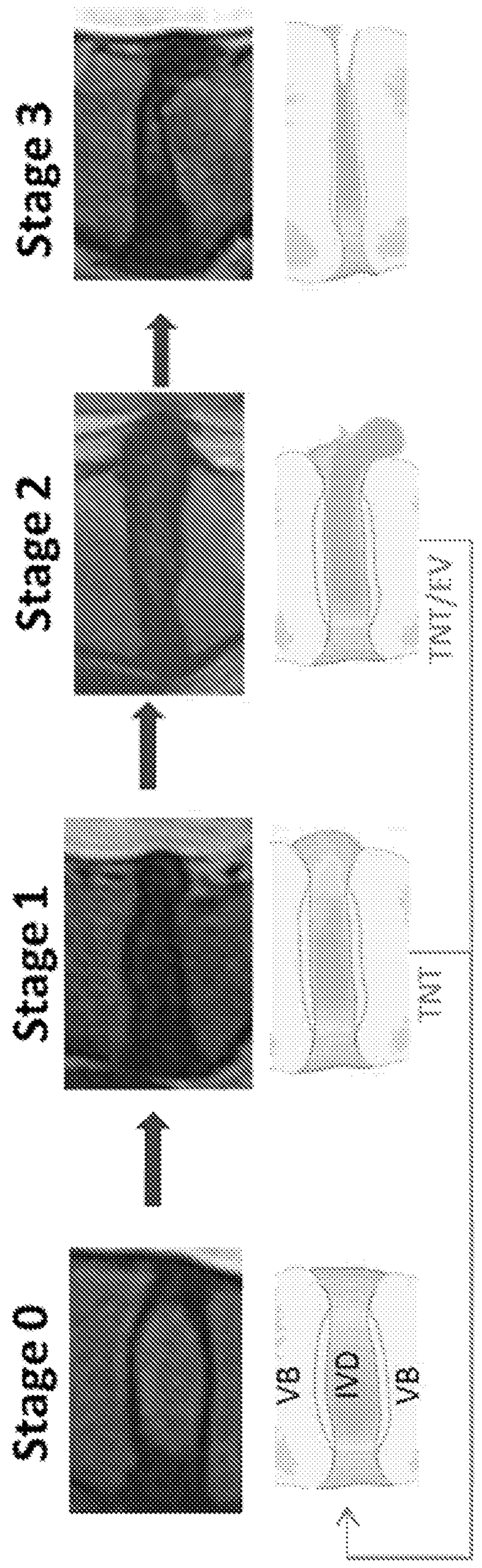

The overarching goal of this technology is to use the combination of transcription factor and TNT/Evs to revert diseased intervertebral disc cells to a healthy phenotype (FIG. 1).

Methods

Transcription factor plasmid expansion via transformation into DH5a *E. coli* cells, selectivity via ampicillin resistance and plasmid DNA isolated NP cells isolated from IVD tissue of human patients (n=5) undergoing spinal surgery and cadaveric tissue and expanded in monolayer until 80% confluent.

FOX Family transcription factor or non-transcription factor containing vector (SHAM) transfected in NP cells via bulk electroporation Neon™ Transfection System MPK5000 (V=1425 Volts, t=30 msec, 1 Pulse). Cells expanded and seeded in 2% Agarose Gels (Ø=8 mm, H=4 mm).

Gels taken down for analysis at Day 0, Week 2, and week 4 and analyzed for: cell viability (Live/Dead Assay Calcein/Ethidium), gene expression (qPCR) and Glycosaminoglycan (GAG) content (Dimethyl methylene Blue Assay (DMMB) normalized to DNA (Hoechst Assay).

Mann Whitney statistical tests used to evaluate significance at $\alpha=0.05$.

Thompson Grading is a standard grade for disc degeneration where 1=healthy and 5=degenerate. Autopsy samples are graded as they do not come directly from diseased tissue. Surgical samples are diseased tissue removed from patients during routine spinal surgery. Table 2 shows human surgical and autopsy NP cells expanded 2 weeks.

TABLE 2

Human autopsy and surgical specimen demographic with level Thompson grade for Autopsy and level for Surgical

| Autopsy | | | | | Surgical | | | |
|---|---|---|---|---|---|---|---|---|
| ID | Sex | Age (years) | Level | Grade | ID | Sex | Age (years) | Level |
| Hu-4 | Female | 49 | L2-L3 | 2.5 | Hs-2 | Male | 26 | L5-S1 |
| Hu-6 | Male | 45 | L2-L3 | 3 | Hs-11 | Male | 28 | L5-S1 |
| Hu-7 | Female | 56 | L2-L3 | 2.5 | Hs-29 | Female | 70 | L5-S1 |
| Hu-9 | Female | 58 | L4-L5 | 2.5 | Hs-34 | Female | 19 | L5-S1 |
| Hu-16 | Female | 19 | L1-L2 | 1.5 | Hs-39 | Male | 60 | L5-S1 |

Figure 2:
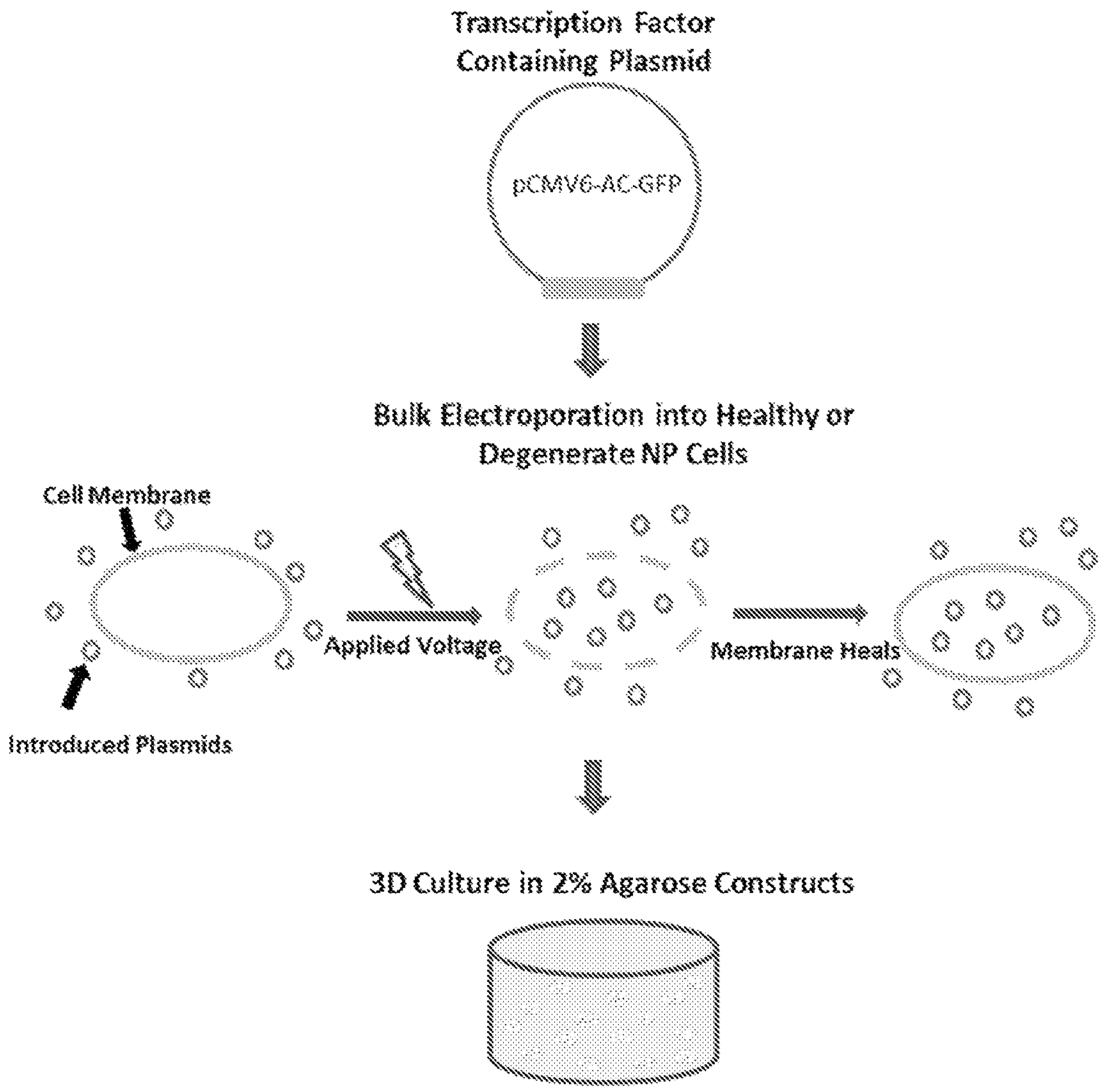
FIG. 2 is a schematic of DNA bulk electroporation into NP cells then seeded in Agarose Gel.

FIG. 2 is a schematic of DNA bulk electroporation into NP cells then seeded in Agarose Gel.

Results

Figure 3:
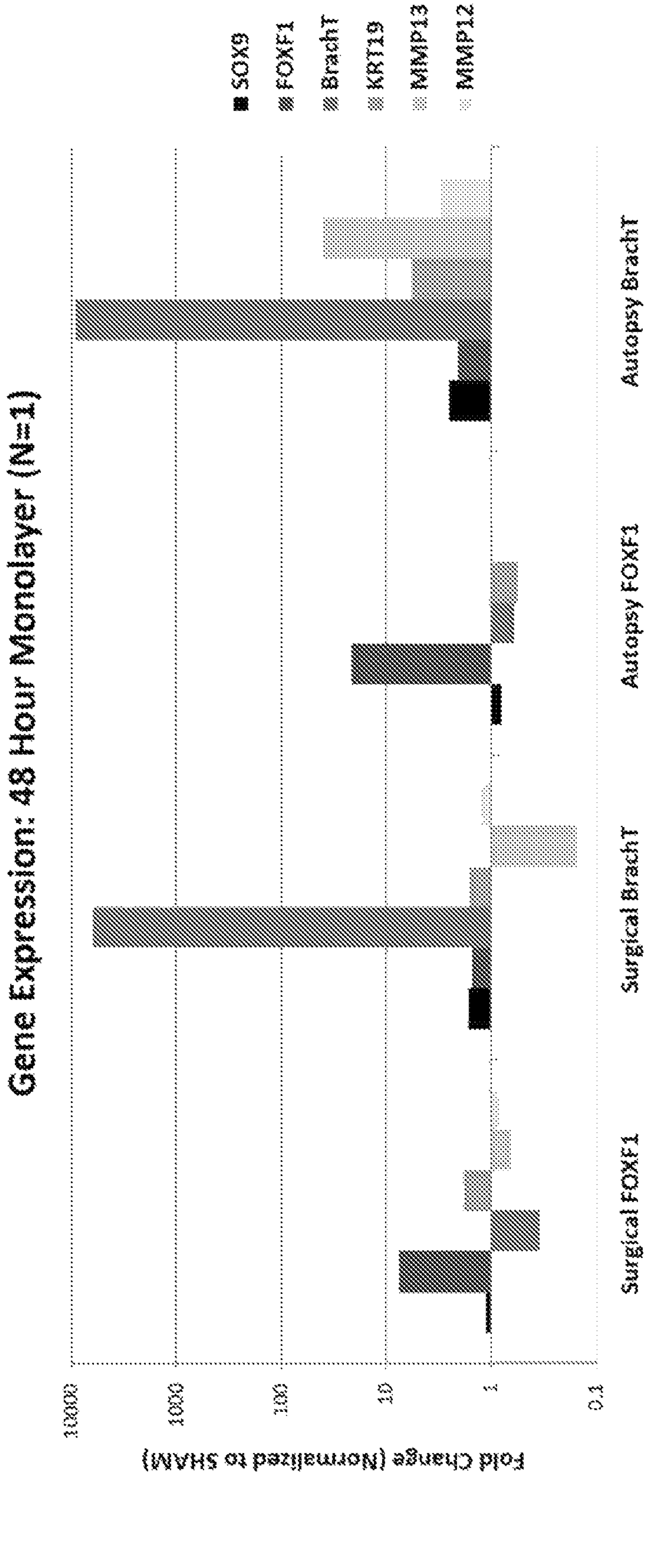

FIG. 3 is a graph showing qPCR Gene expression data validating that the transcription factor was successfully transmitted. X-axis=type of tissue and transcription factor. Colors indicate the gene being tested for.

Figure 4:
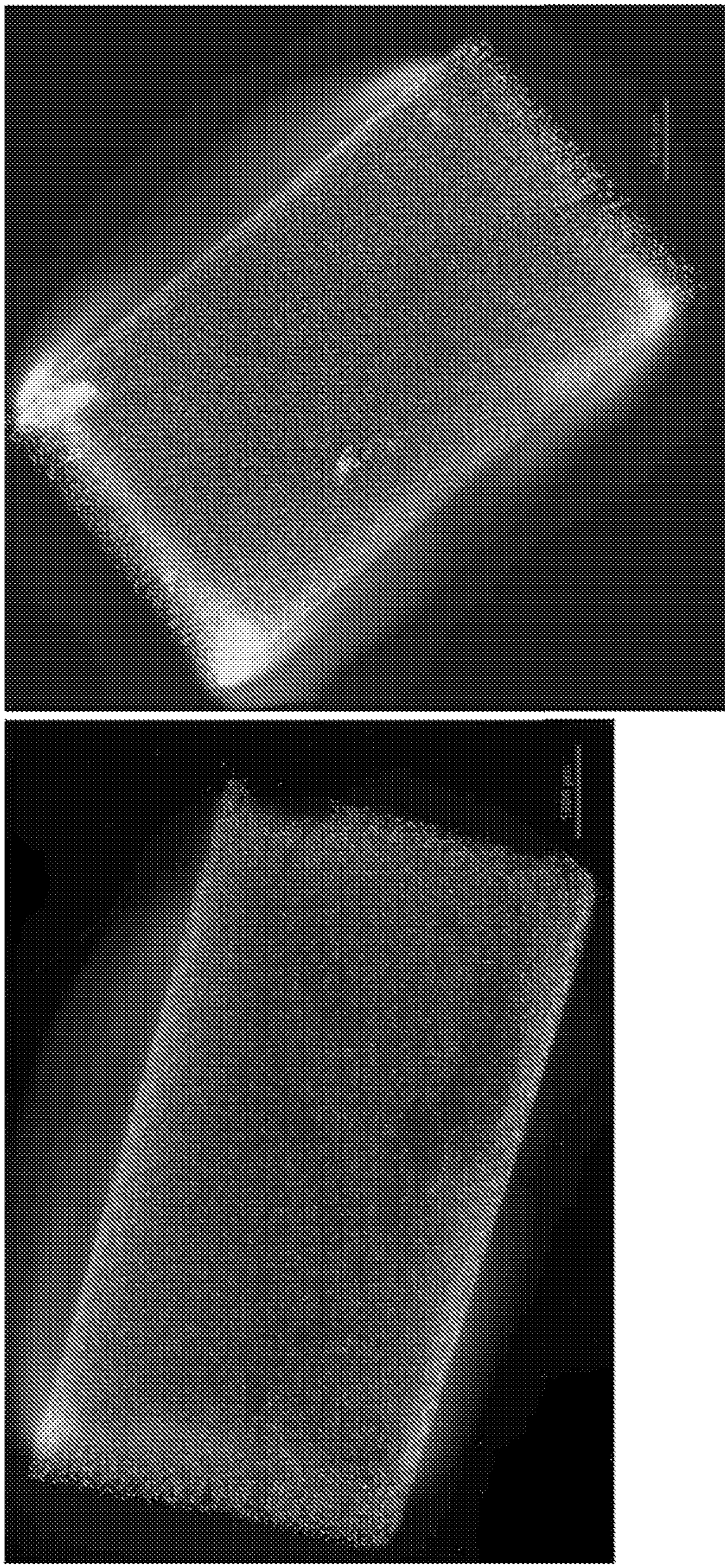
FIG. 4 contains representative viability images (4× Stitched) of Gels at day 0 and 4 Weeks. (Green=Live, Red=Dead).

FIG. 4 contains representative viability images (4× Stitched) of Gels at day 0 and 4 Weeks. (Green=Live, Red=Dead).

Figure 5A:
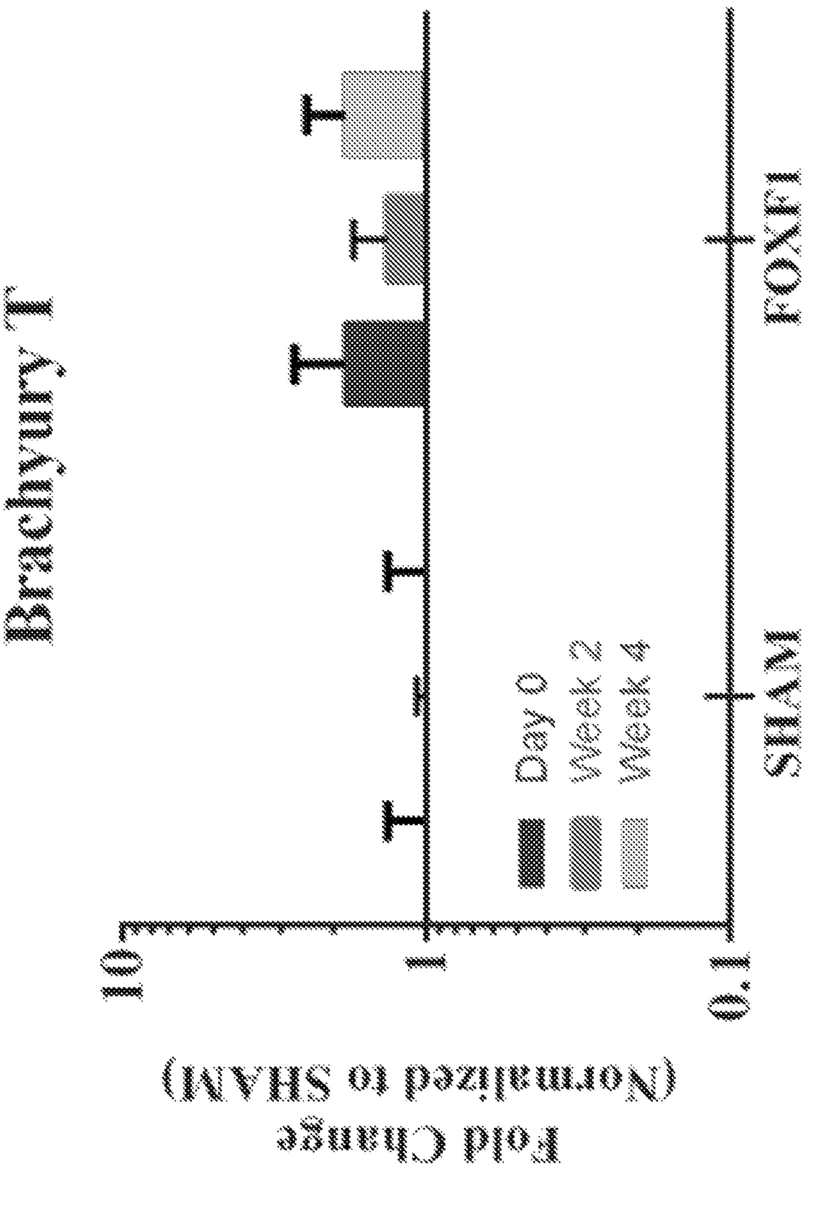
FIGS. 5A and 5B are graphs showing Brachyury T expression in autopsy (FIG. 5A) and surgical (FIG. 5B) nucleus pulposus cells after sham or FOXF1 treatment.
Figure 5B:
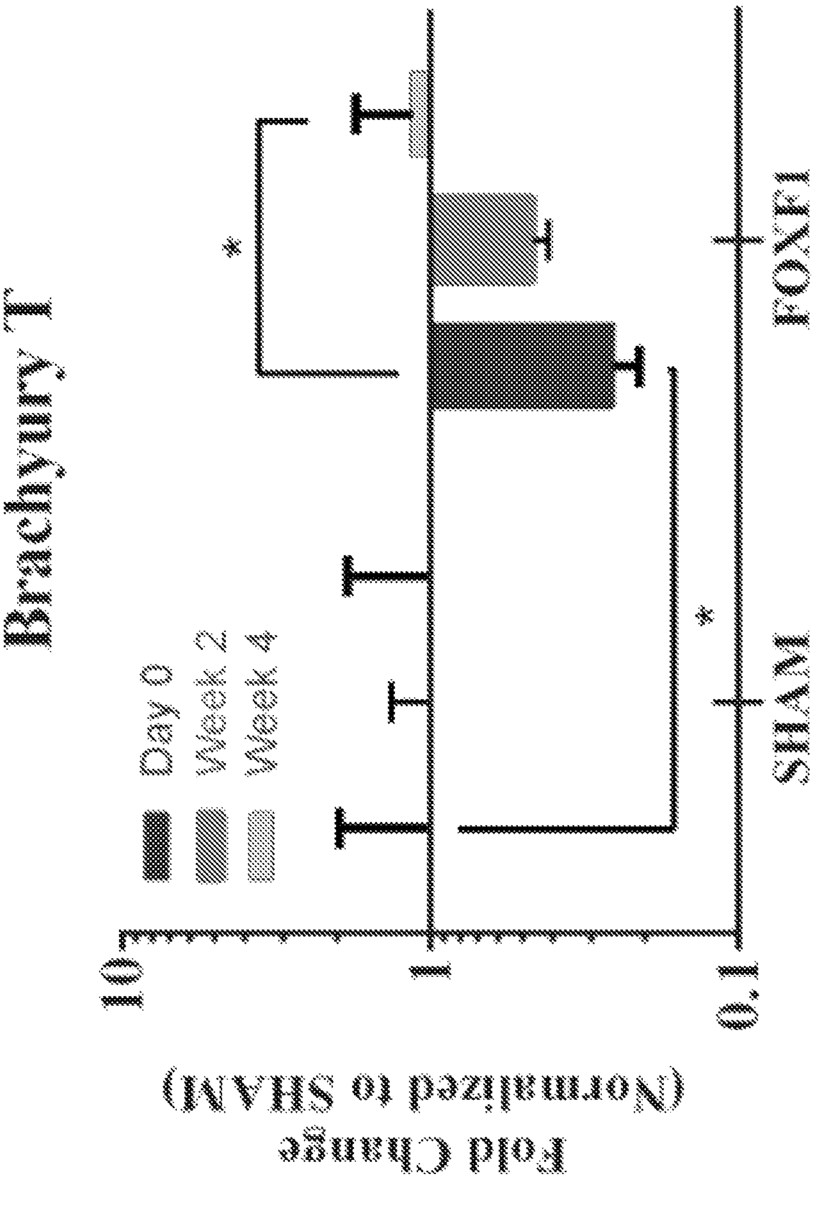
Figure 5C:
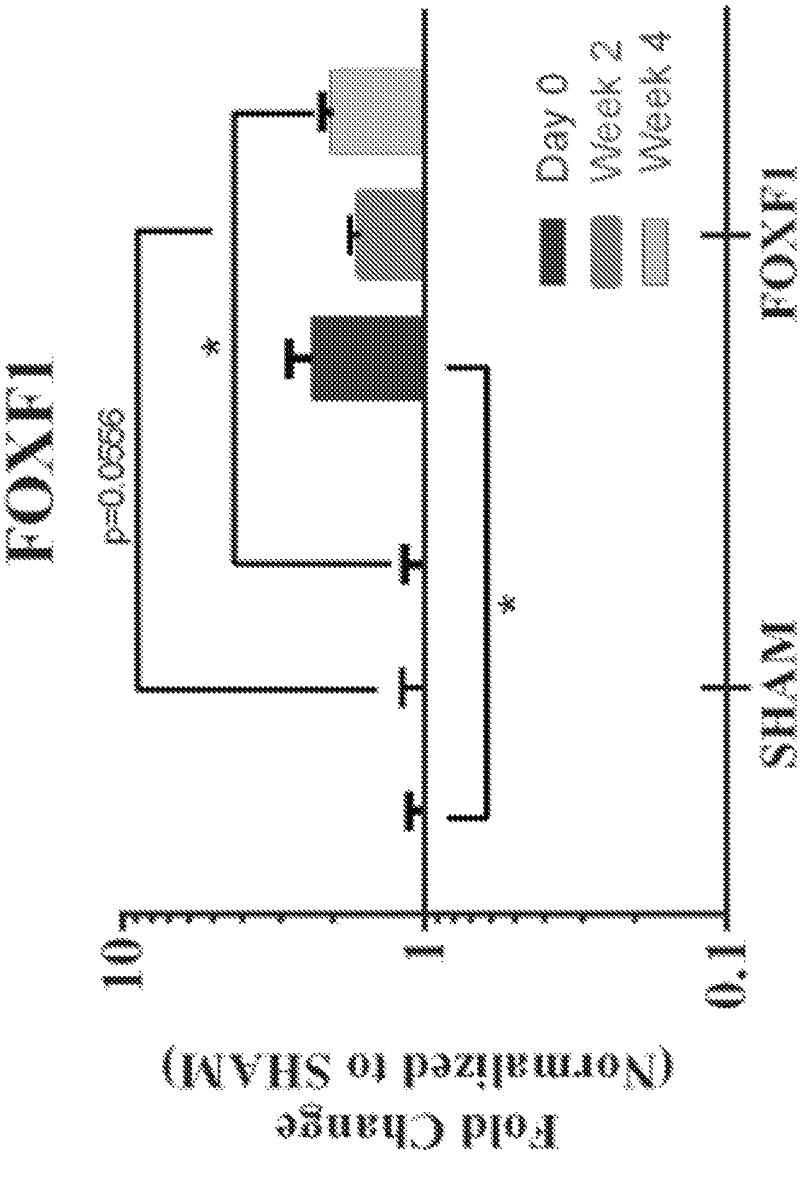
FIGS. 5C and 5D are graphs showing FOXF1 (FIG. 5C) and KRT19 (FIG. 5D) expression in healthy nucleus pulposus cells after sham or FOXF1 treatment.
Figure 5D:
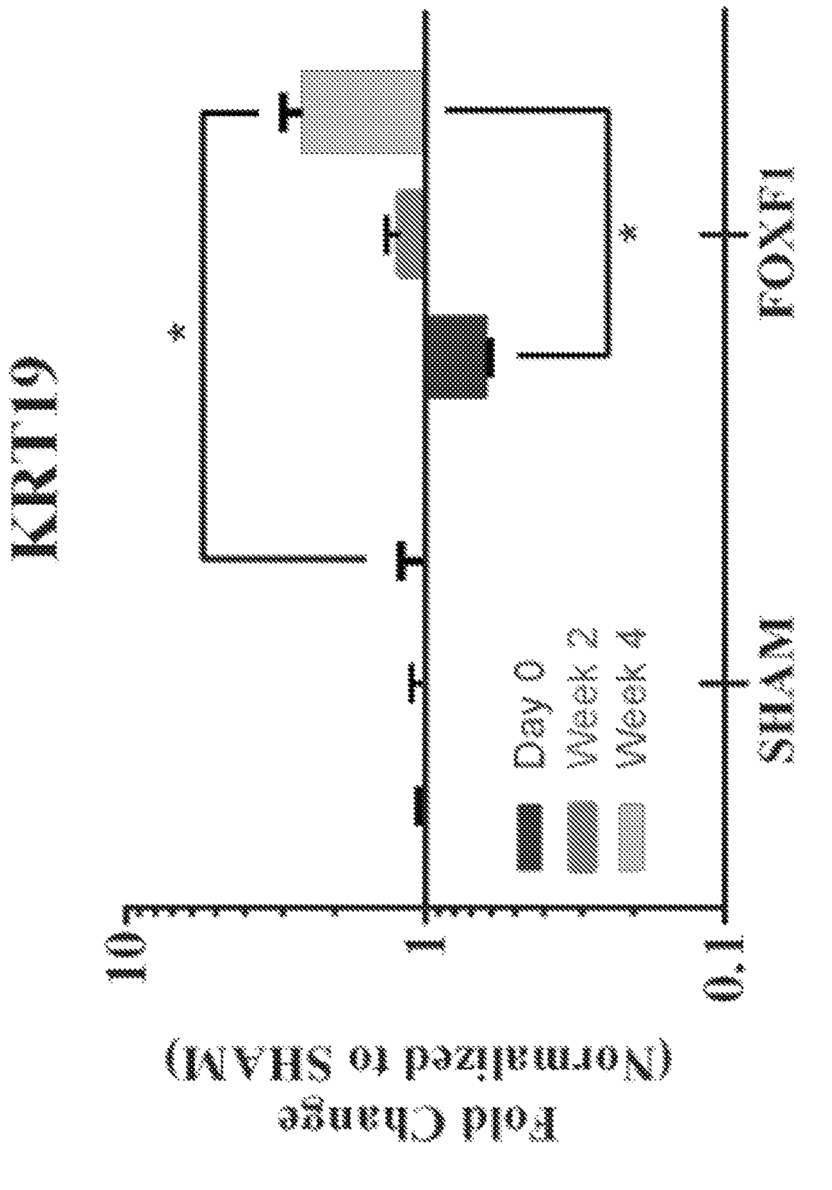

FIGS. 5A and 5B are graphs showing Brachyury T expression in autopsy (FIG. 5A) and surgical (FIG. 5B) nucleus pulposus cells after sham or FOXF1 treatment. FIGS. 5C and 5D are graphs showing FOXF1 (FIG. 5C) and KRT19 (FIG. 5D) expression in healthy nucleus pulposus cells after sham or FOXF1 treatment.

Figure 6A:
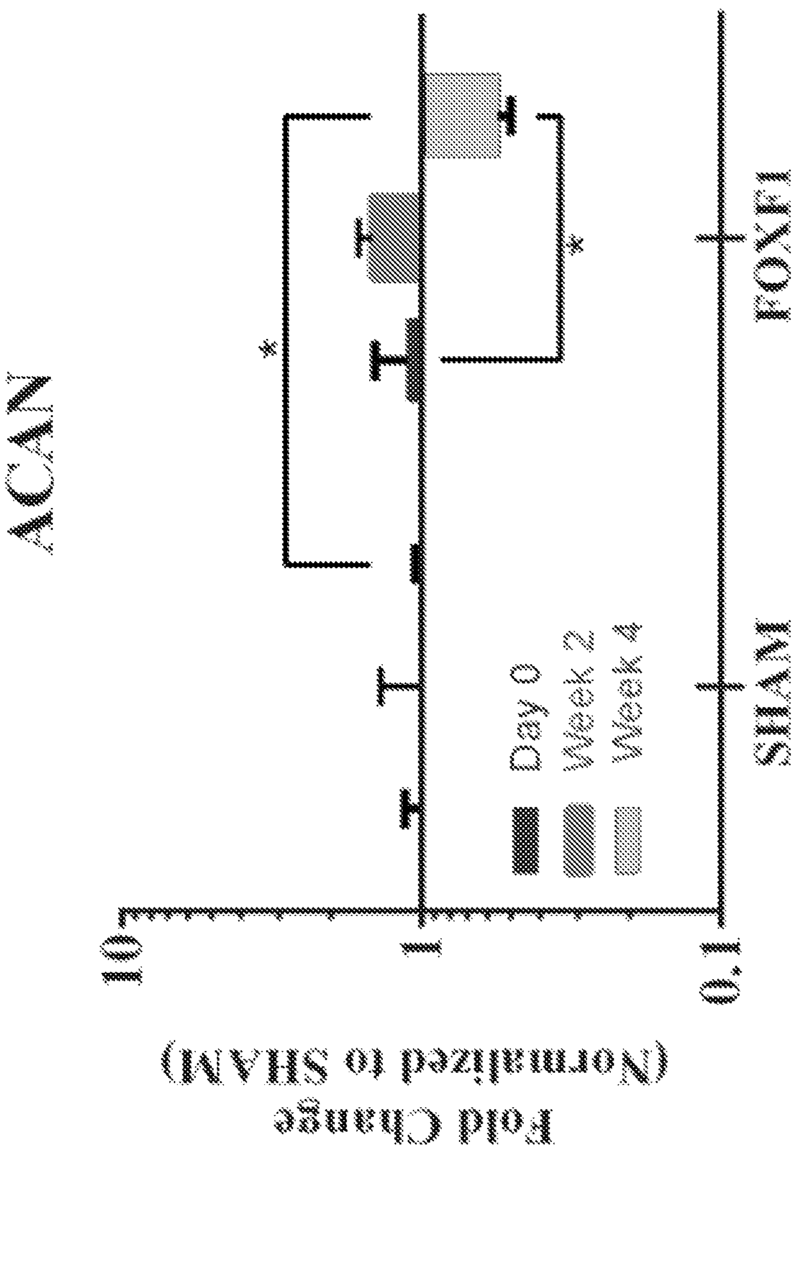
FIGS. 6A and 6B are graphs showing ACAN (FIG. 6A) and COL2 (FIG. 6B) expression in healthy nucleus pulposus cells after sham or FOXF1 treatment.
Figure 6B:
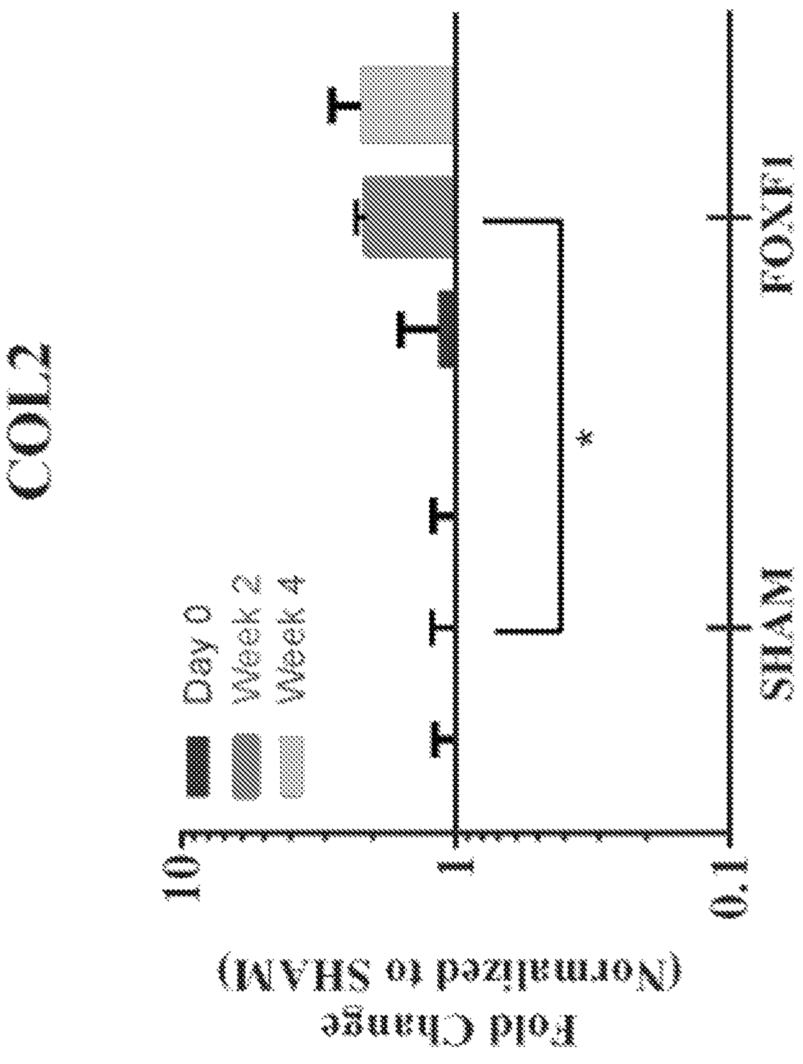

FIGS. 6A and 6B are graphs showing ACAN (FIG. 6A) and COL2 (FIG. 6B) expression in healthy nucleus pulposus cells after sham or FOXF1 treatment.

Figure 7A:
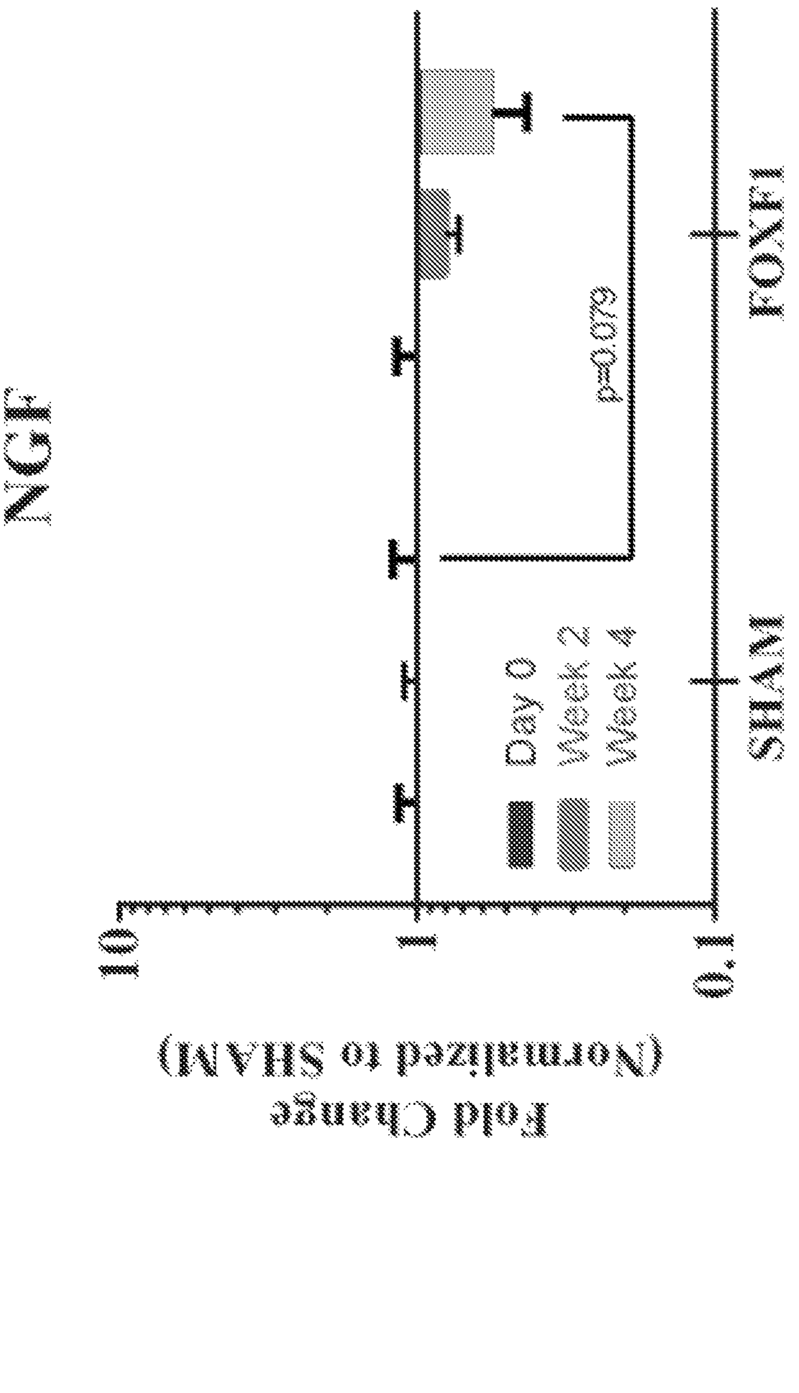
FIGS. 7A and 7B are graphs showing NGF expression in autopsy (FIG. 7A) and surgical (FIG. 7B) nucleus pulposus cells after sham or FOXF1 treatment.
Figure 7B:
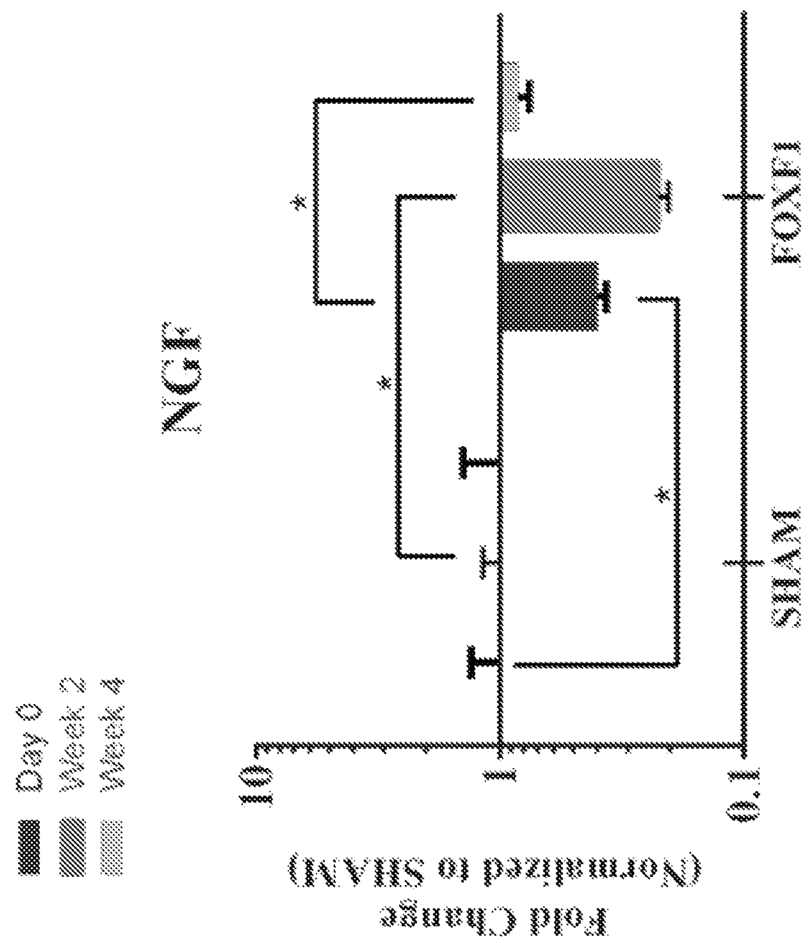

FIGS. 7A and 7B are graphs showing NGF expression in autopsy (FIG. 7A) and surgical (FIG. 7B) nucleus pulposus cells after sham or FOXF1 treatment.

Figure 8A:
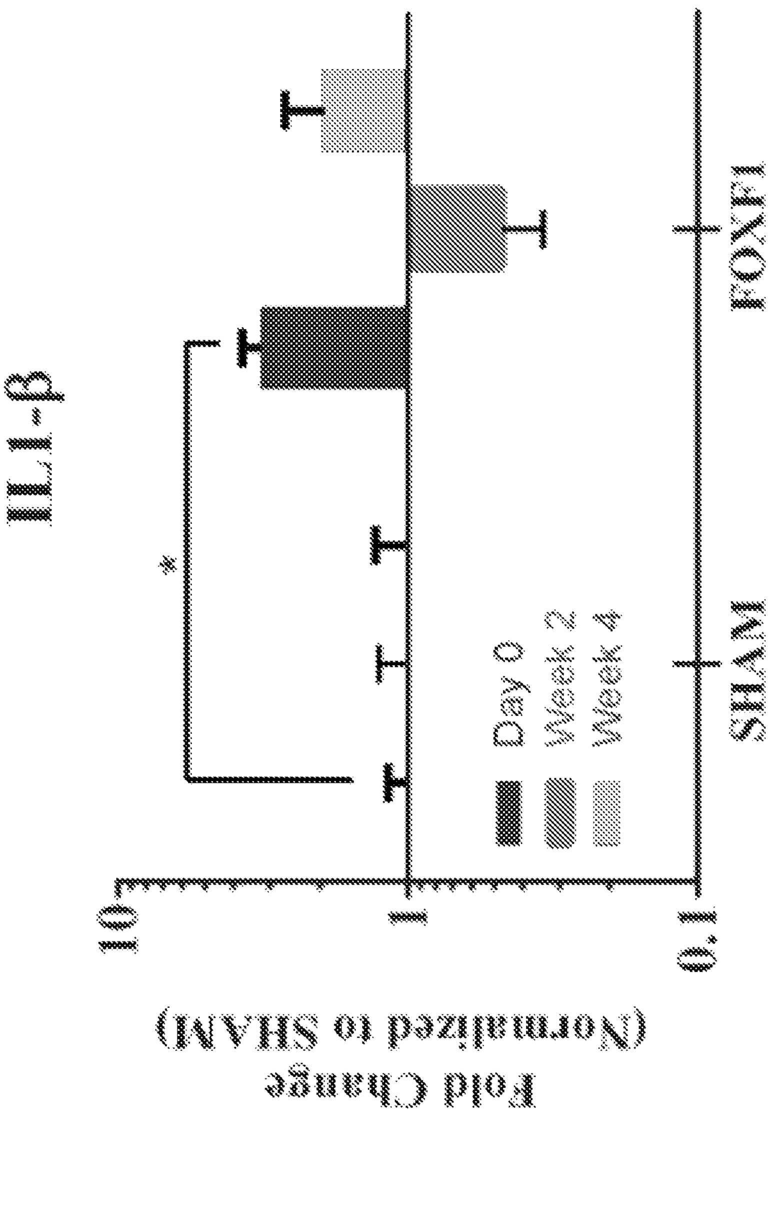
FIGS. 8A and 8B are graphs showing IL1-8 expression in autopsy (FIG. 8A) and surgical (FIG. 8B) nucleus pulposus cells after sham or FOXF1 treatment.
Figure 8B:
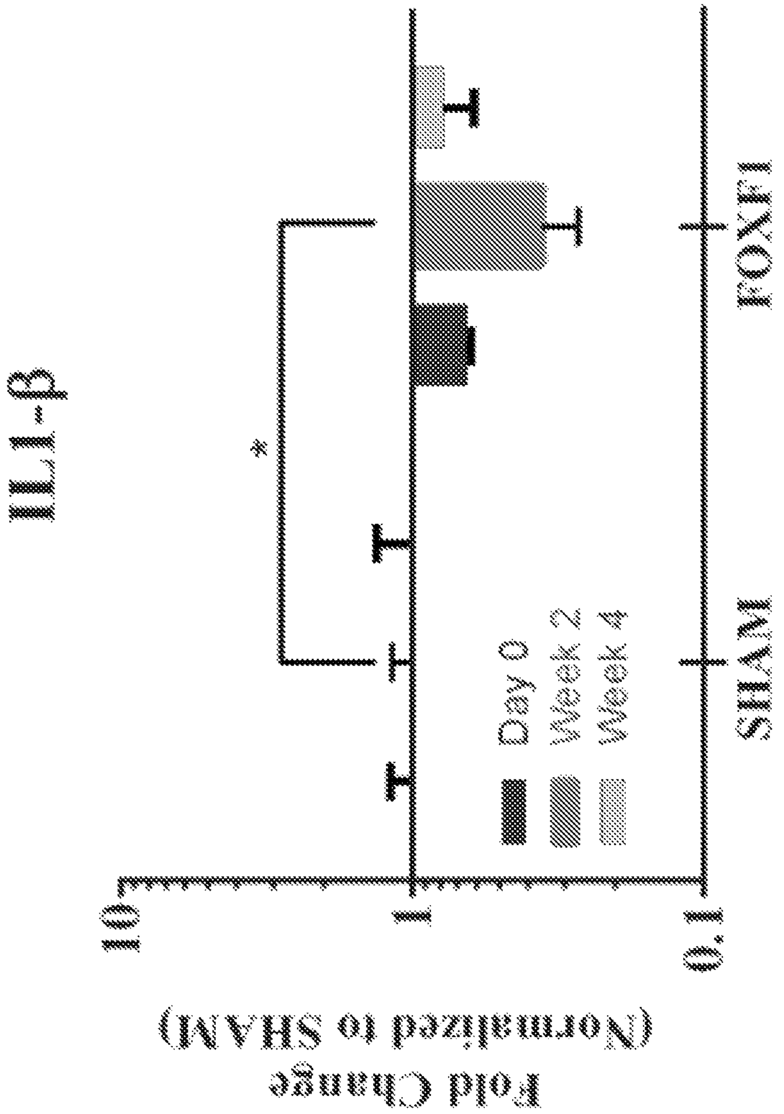
Figure 8C:
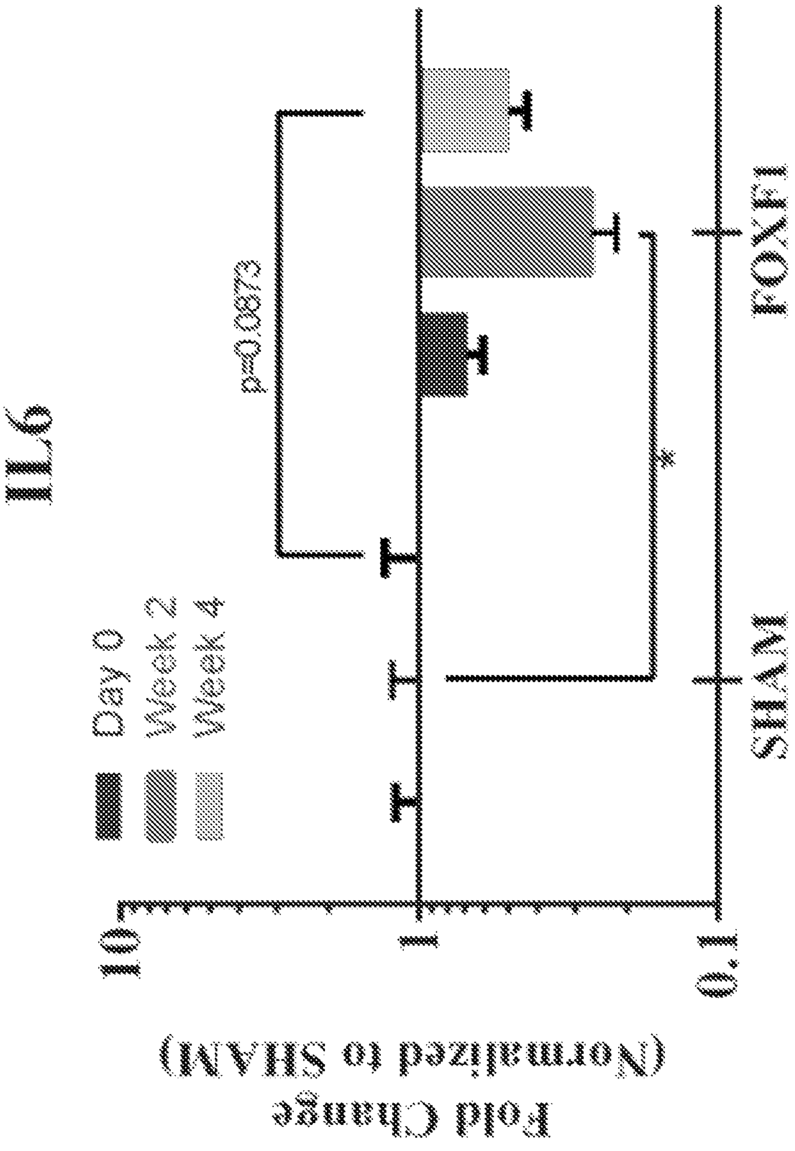
FIG. 8C is a graph showing IL6 expression in nucleus pulposus cells after sham or FOXF1 treatment of surgical tissue.

FIGS. 8A and 8B are graphs showing IL1-8 expression in autopsy (FIG. 8A) and surgical (FIG. 8B) nucleus pulposus cells after sham or FOXF1 treatment. FIG. 8C is a graph showing IL6 expression in nucleus pulposus cells after sham or FOXF1 treatment.

Figure 9A:
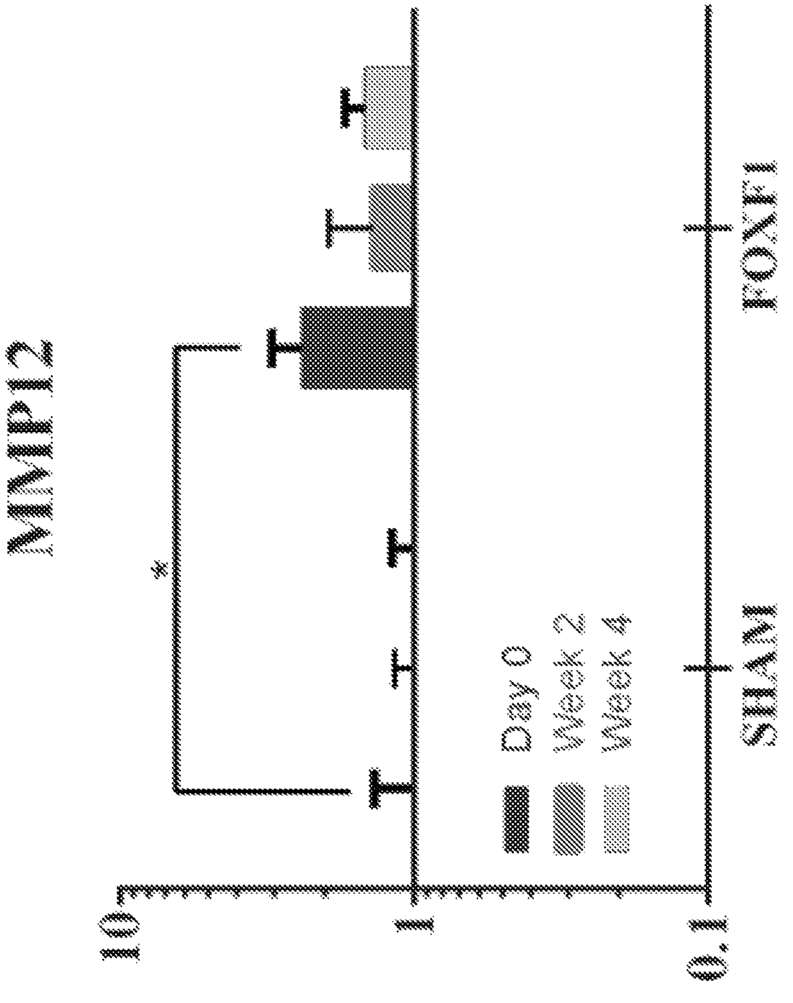
FIGS. 9A and 9B are graphs showing MMP12 expression in autopsy (FIG. 9A) and surgical (FIG. 9B) nucleus pulposus cells after sham or FOXF1 treatment.
Figure 9B:
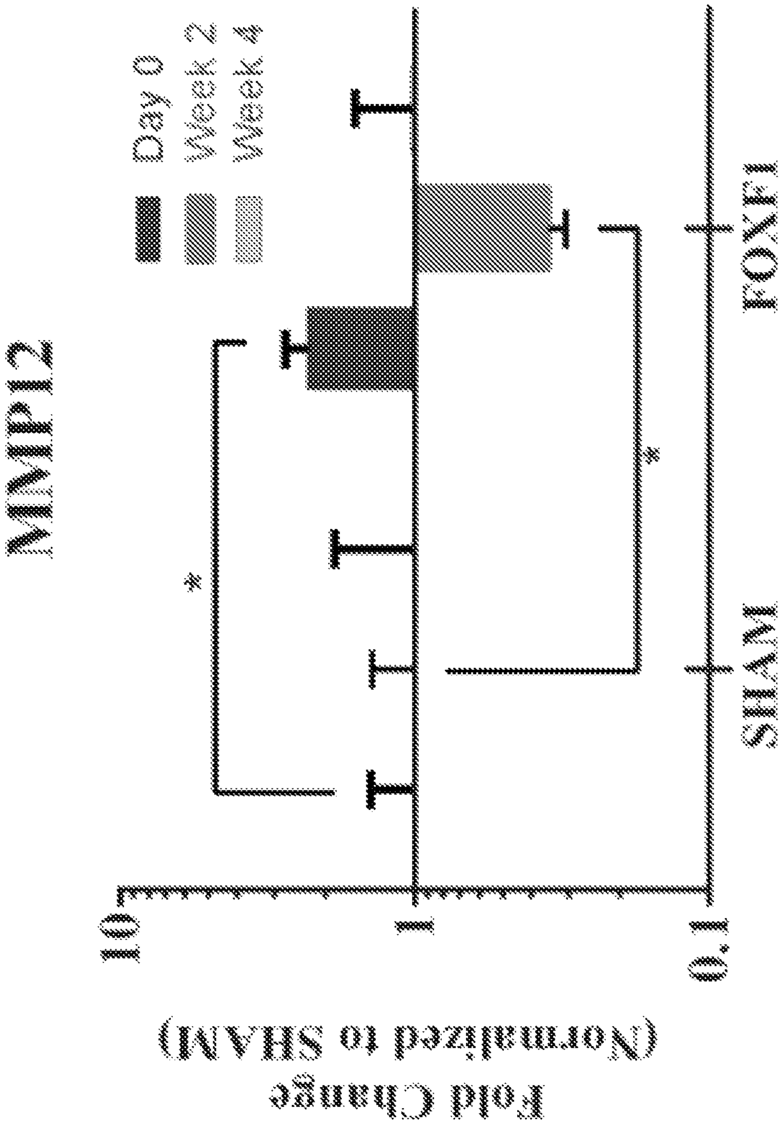
Figure 9C:
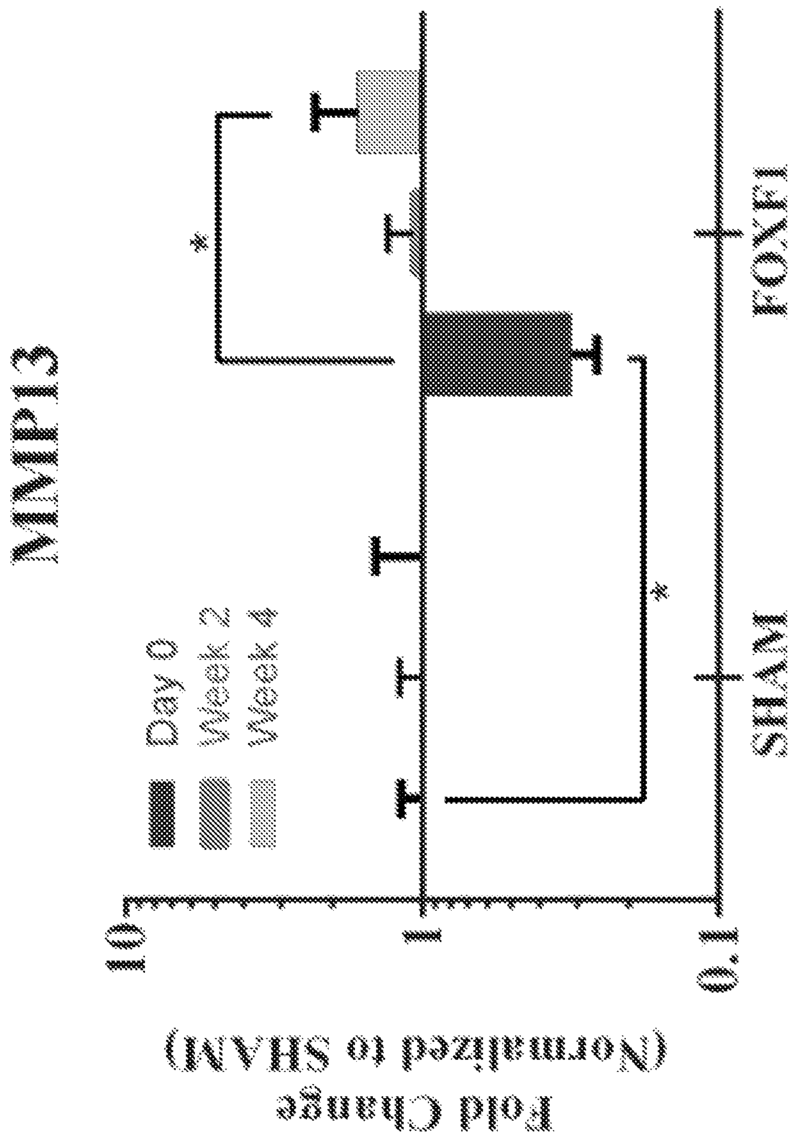
FIGS. 9C and 9D are graphs showing MMP13 expression in autopsy (FIG. 9C) and surgical (FIG. 9D) nucleus pulposus cells after sham or FOXF1 treatment.
Figure 9D:
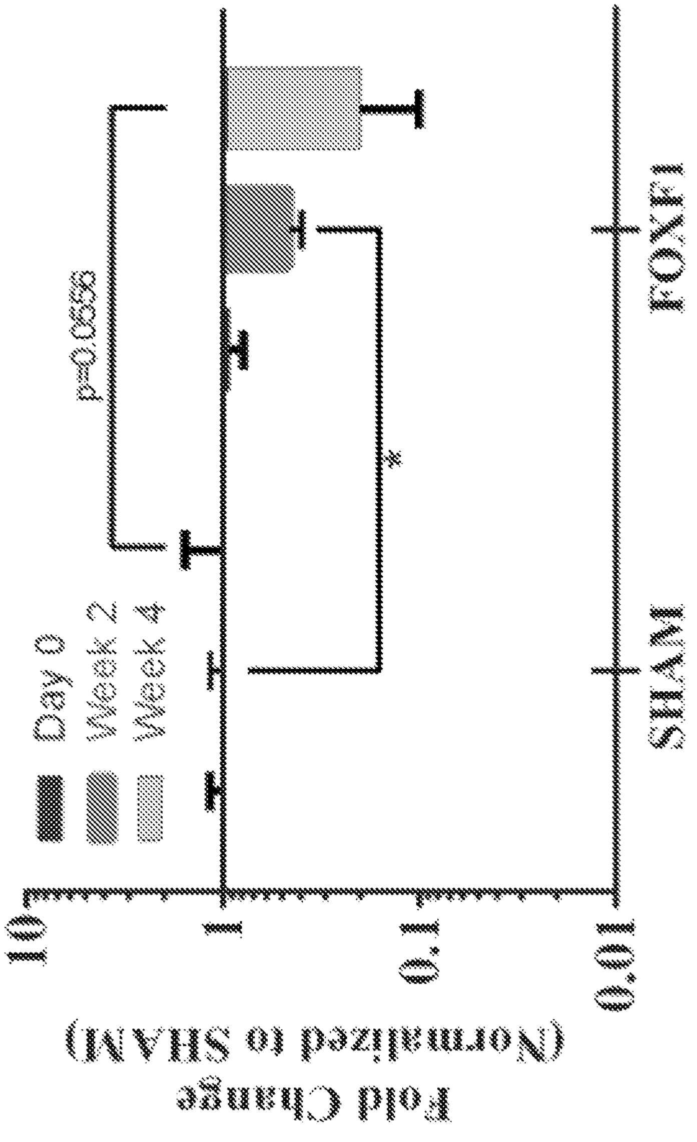

FIGS. 9A and 9B are graphs showing MMP12 expression in autopsy (FIG. 9A) and surgical (FIG. 9B) nucleus pulposus cells after sham or FOXF1 treatment. FIGS. 9C and 9D are graphs showing MMP13 expression in autopsy (FIG. 9C) and surgical (FIG. 9D) nucleus pulposus cells after sham or FOXF1 treatment.

Figure 10A:
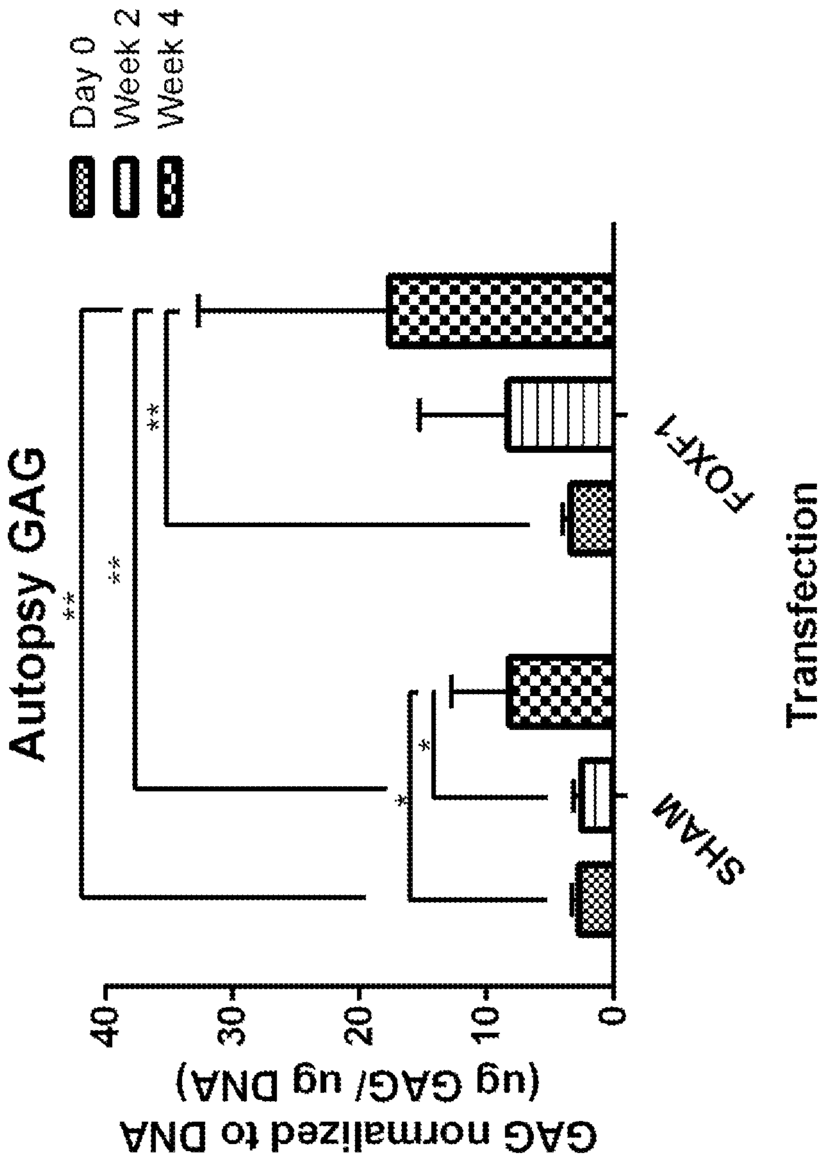
FIGS. 10A and 10B are bar graphs showing GAG content in autopsy (FIG. 10A) and surgical (FIG. 10B) nucleus pulposus cells after sham or FOXF1 treatment.
Figure 10B:
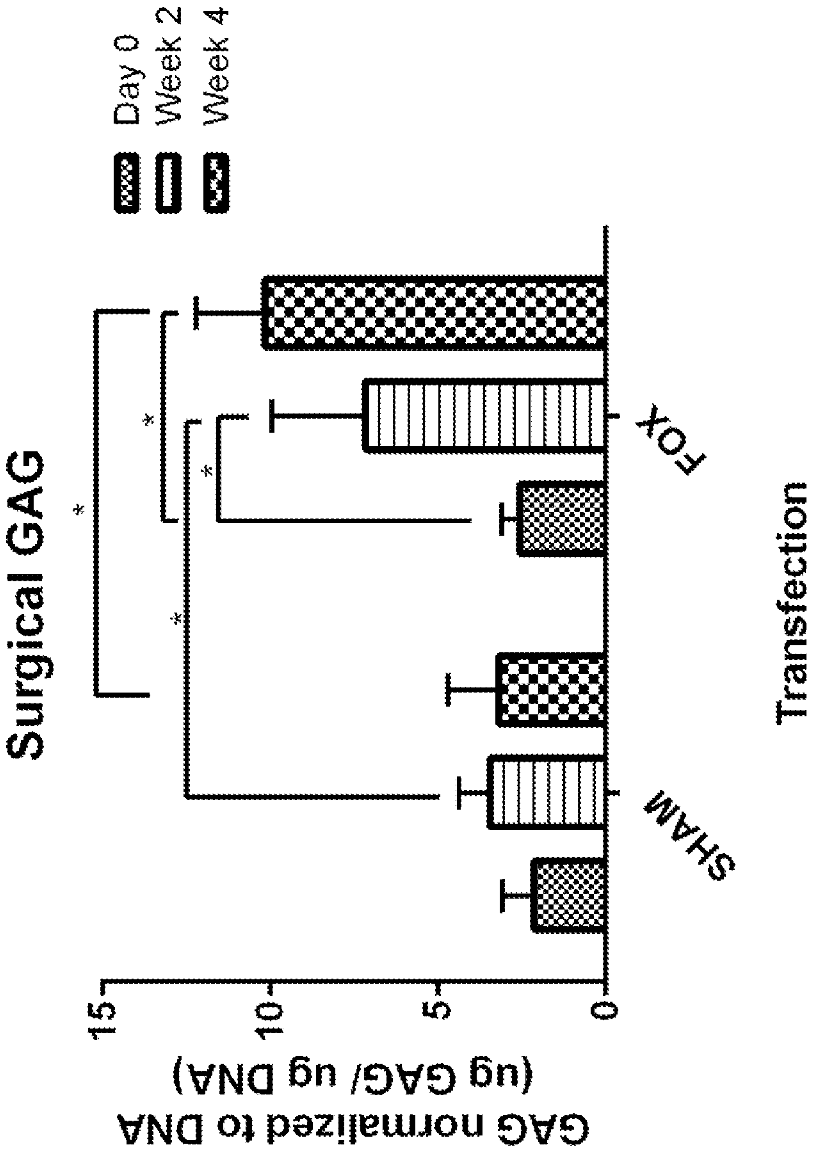

FIGS. 10A and 10B are bar graphs showing GAG content in autopsy (FIG. 10A) and surgical (FIG. 10B) nucleus pulposus cells after sham or FOXF1 treatment.

CONCLUSION

This study demonstrates: (i) the ability to transfect degenerate cells using bulk electroporation, (ii) transfected cell maintained viability over 4 weeks of culture in 3D constructs, (iii) introduction of FOX family gene into the cytosolic environment of the cell induces proteoglycan (GAG) production critical for IVD function and (iv) inhibition of inflammatory and neuron growth factor.

Example 2: Non-Viral Transfection of Human Intervertebral Disc Cells with Developmental Factors Induces Reprogramming to a Healthy Anti-Catabolic/Inflammatory Phenotype with Enhanced Extracellular Matrix Accumulation Low back pain (LBP) is the leading cause of disability worldwide with an associated socioeconomic burden of over $100 billion annually in the U.S alone [Katz, J. et al, 2006]. Intervertebral disc (IVD) degeneration is a major contributor to LBP and is characterized by decreases in cellularity and proteoglycan synthesis, upregulation of matrix degrading enzymes (MMPs), and increases in pro-inflammatory factors with neurovascular invasion[Rodriques-Pinto R. et al, 2014; Freemont A. J. et al, 2009]. Current treatment strategies are highly invasive and fail to target the underlying pathology or promote tissue repair. Pro-anabolic approaches have been proposed which includes gene therapy through viral infection, but this has raised safety concerns due to mutagenesis and unwarranted immune responses. To avoid such safety risks, electroporation of plasmids carrying DNA for transcription factors can be introduced into endogenous cells without alteration of native DNA to stimulate IVD repair. The transcription factor, Brachyury (BrachT), is expressed in the developing notochord and is associated with maintaining a healthy immature nucleus pulposus (NP) phenotype [Vujovic, S. et al, 2006; Tang, R. et al, 2018]. As disclosed herein, delivery of BrachT into degenerate human IVD cells can reprogram diseased NP cells into healthy cells with increased proteoglycan and decreased inflammatory, catabolic and pain associated factors which are critical for maintaining the structure and function of the healthy IVD. Thus, the overall objective of this study was to examine the effects of BrachT transfection on human NP cell phenotype and function.

Methods

BrachT transcription factor plasmids (OriGene Tech, Cat: SC303281) were expanded via transformation into DH5a *E. coli* cells with ampicillin resistance and plasmid DNA isolated for downstream electroporation. Human NP cells were isolated from non-degenerate (ND) cadaveric IVDs from autopsy (n=5, 19-58 y.o) or from the painful-degenerate (PD) IVD tissue of human patients with back pain (n=5, 19-70 y.o, IRB: 2015H0385) undergoing microdiscectomy (2 mg/mL Pronase-1 hour, 2 mg/mL Collagenase 11-4 hours). NP cells were expanded in monolayer (p2) until 80% confluent before bulk electroporation with empty plasmids (SHAM) or BrachT plasmids via Neon™ Transfection System MPK5000 (V=1425 Volts, t=30 msec, 1 Pulse). Successful transfection was verified with RT-qPCR at 48 hours. Transfected cells were then expanded in disc cell media (High glucose DMEM, 10% FBS, 1% P/S, 50 μg/ml ascorbic acid fresh) and seeded in 2% 3D agarose gel constructs at 20E6 cells/mL. Dependent variables were examined at day 0, week 2 and week 4 for cell viability (Calcein/Ethidium staining), extracellular matrix, phenotypic marker and inflammatory/catabolic gene expression (RT-qPCR) and proteoglycan/GAG content (Dimethylmethylene Blue Assay with DNA/Hoechst normalization). Non-parametric statistical tests were used (Mann-Whitney Tests, $\alpha=0.05$).

Results

Cell viability remained high for all groups and BrachT gene expression was maintained over 4 weeks in both ND and PD cells with a decline in PD cells at week 4 only (fold change >100).

Figures 11A, 11B:
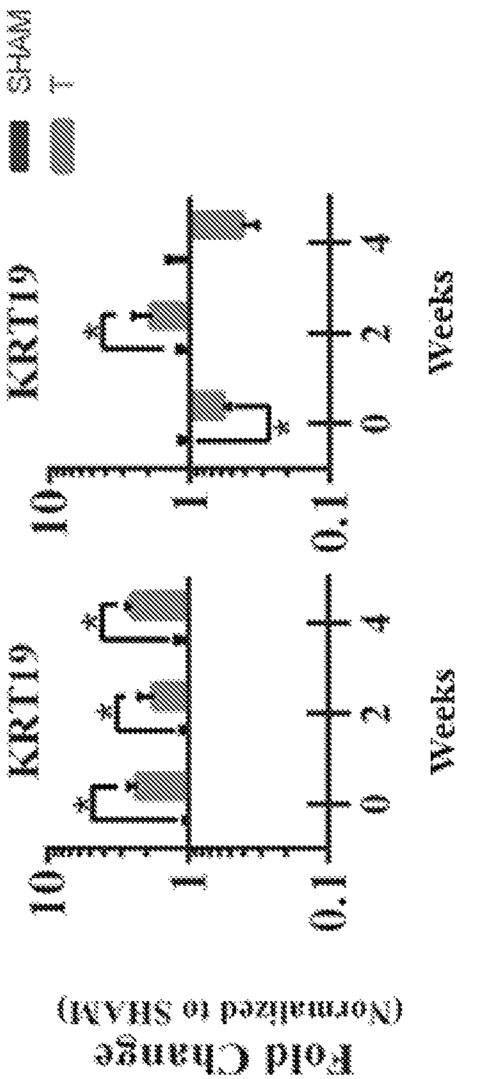
FIGS. 11A and 11B are bar graphs showing KRT19 gene expression at day 0, week 2, and week 4 of BrachT transfected groups normalized to SHAM for non-degenerate (ND, FIG. 11A) and painful-degeneration (PD, FIG. 11B) groups. * $p<0.05$.

Expression of NP marker KRT19 was significantly increased in BrachT transfected PD cells at 2 weeks compared to SHAM controls while ND cells showed significant increases at all time-points (FIGS. 11A and 11B, $p<0.05$).

Figure 12B:
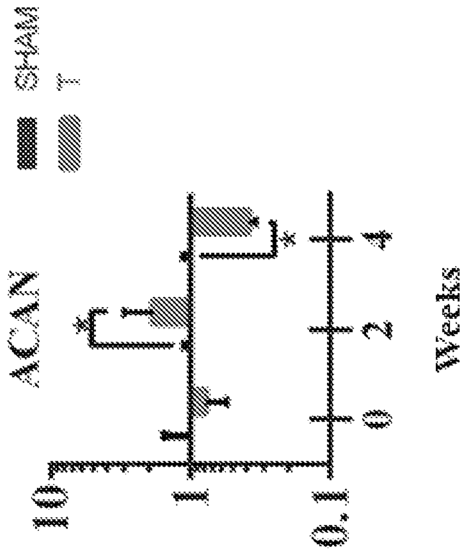
FIGS. 12A and 12B are bar graphs showing ACAN gene expression at day 0, week 2, and week 4 of BrachT transfected groups normalized to SHAM for non-degenerate (ND, FIG. 12A) and painful-degeneration (PD, FIG. 12B) groups. * $p<0.05$.
Figure 12A:
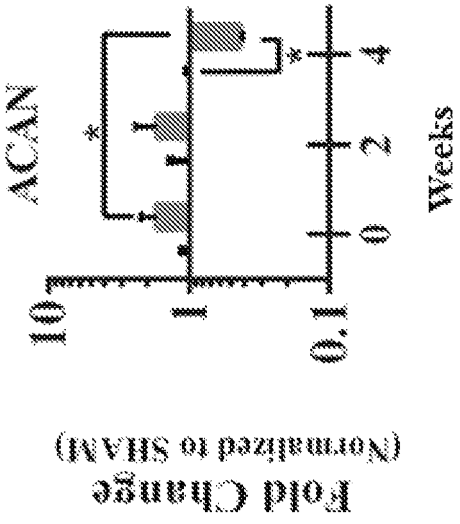

Expression of matrix protein ACAN was increased at 2 weeks in transfected ND and PD cells (significant for PD cells) with significant decreases at 4 weeks for both groups (FIGS. 12A and 12B).

Figure 13A:
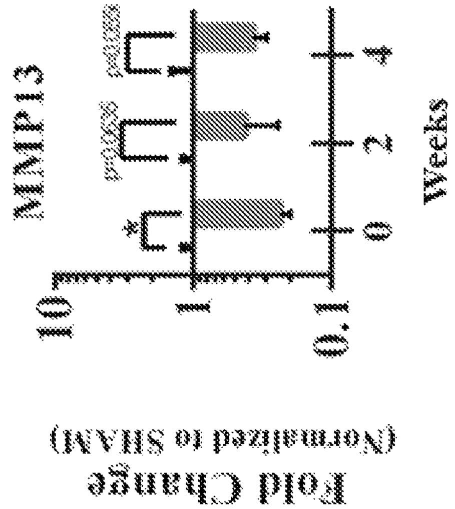
FIGS. 13A and 13B are bar graphs showing MMP13 gene expression at day 0, week 2, and week 4 of BrachT transfected groups normalized to SHAM for non-degenerate (ND, FIG. 13A) and painful-degeneration (PD, FIG. 13B) groups. * $p<0.05$.
Figure 13B:
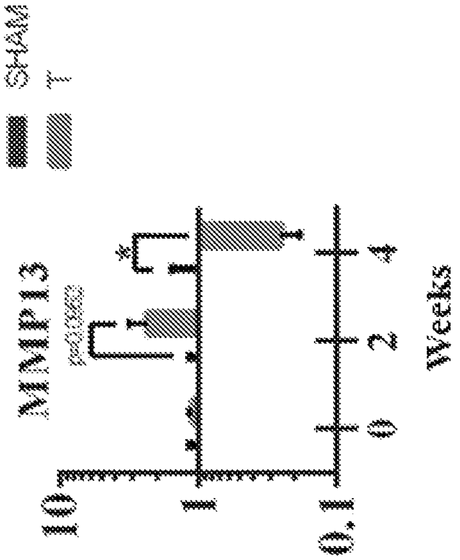

Expression of MMP13 was significantly decreased in transfected ND cells at all time points and demonstrated a significant decrease at week 4 for transfected PD cells (FIGS. 13A and 13B).

Figure 14B:
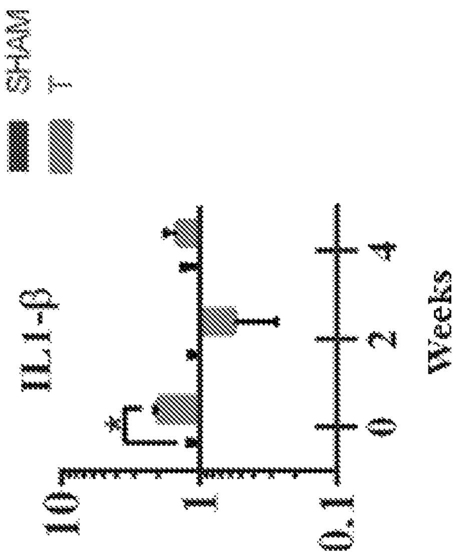
FIGS. 14A and 14B are bar graphs showing IL1-8 gene expression at day 0, week 2, and week 4 of BrachT transfected groups normalized to SHAM for non-degenerate (ND, FIG. 14A) and painful-degeneration (PD, FIG. 14B) groups. * $p<0.05$.
Figure 14A:
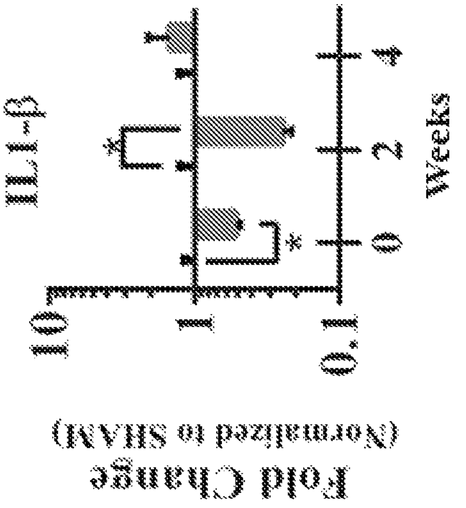
Figures 15A, 15B:
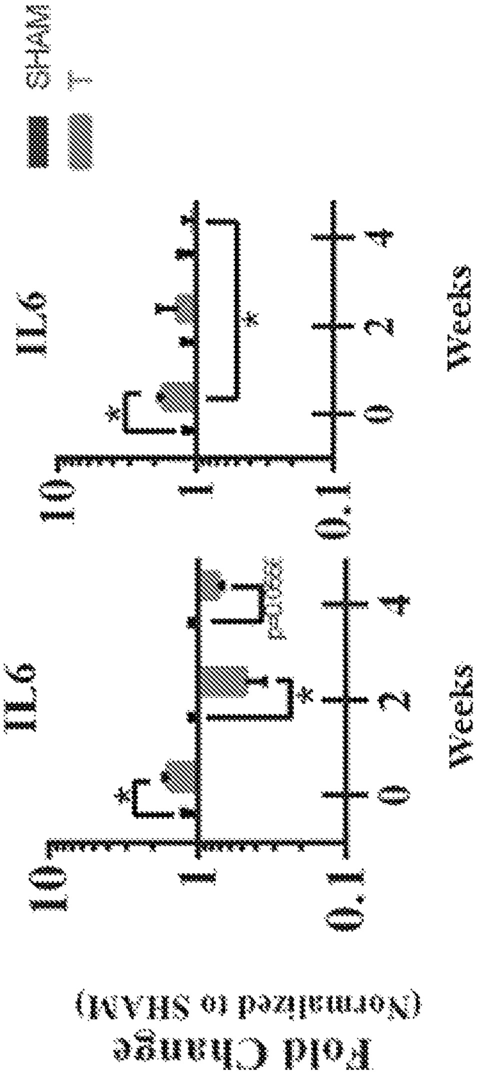
FIGS. 15A and 15B are bar graphs showing IL6 gene expression at day 0, week 2, and week 4 of BrachT transfected groups normalized to SHAM for non-degenerate (ND, FIG. 15A) and painful-degeneration (PD, FIG. 15B) groups. * $p<0.05$.

Pro-inflammatory cytokines IL-1β (FIGS. 14A and 14B) and IL-6 (FIGS. 15A and 15B) demonstrated decreased expression at 2 weeks for transfected ND samples but showed an initial increase for transfected PD samples that decreased with time.

Figures 16A, 16B:
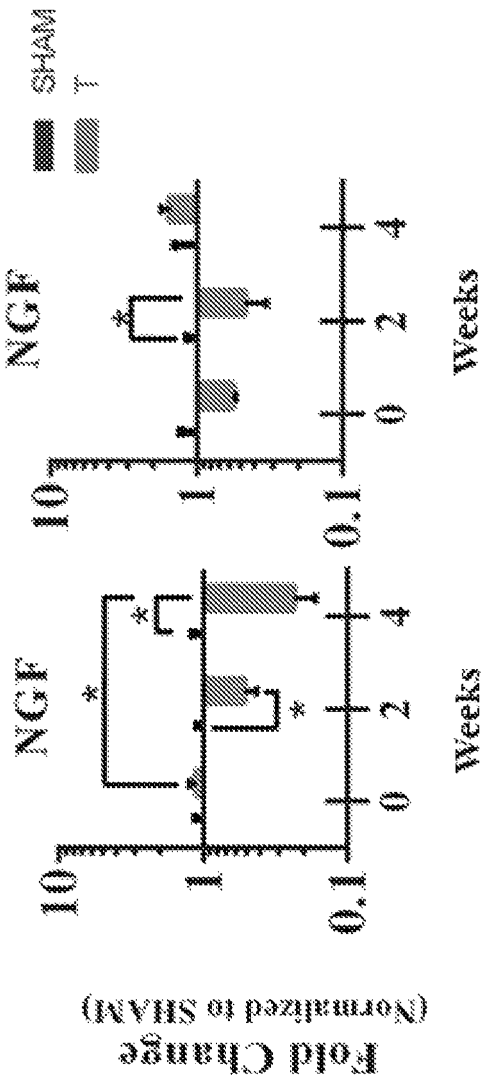
FIGS. 16A and 16B are bar graphs showing NGF gene expression at day 0, week 2, and week 4 of BrachT transfected groups normalized to SHAM for non-degenerate (ND, FIG. 16A) and painful-degeneration (PD, FIG. 16B) groups. * $p<0.05$.

Nerve growth factor (NGF) showed a significant decrease in expression at week 2 for transfected PD cells but significant decreases at 2 and 4 weeks in transfected ND cells (FIGS. 16A and 16B).

Figure 17B:
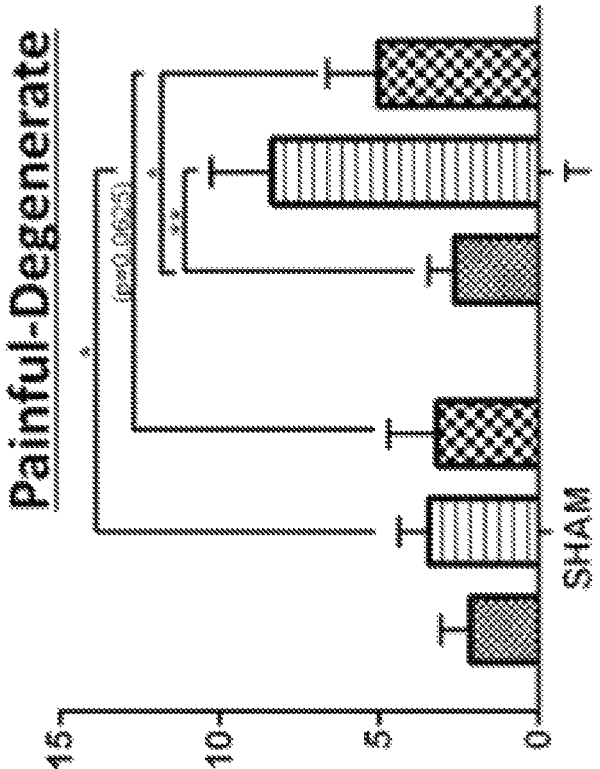
FIGS. 17A and 17B are bar graphs showing GAG normalized to DNA for non-degenerate (FIG. 17A) and painful-degenerate (FIG. 17B) cells for SHAM compared to BrachT transfected groups. * $p<0.05$, ** $p<0.005$.
Figure 17A:
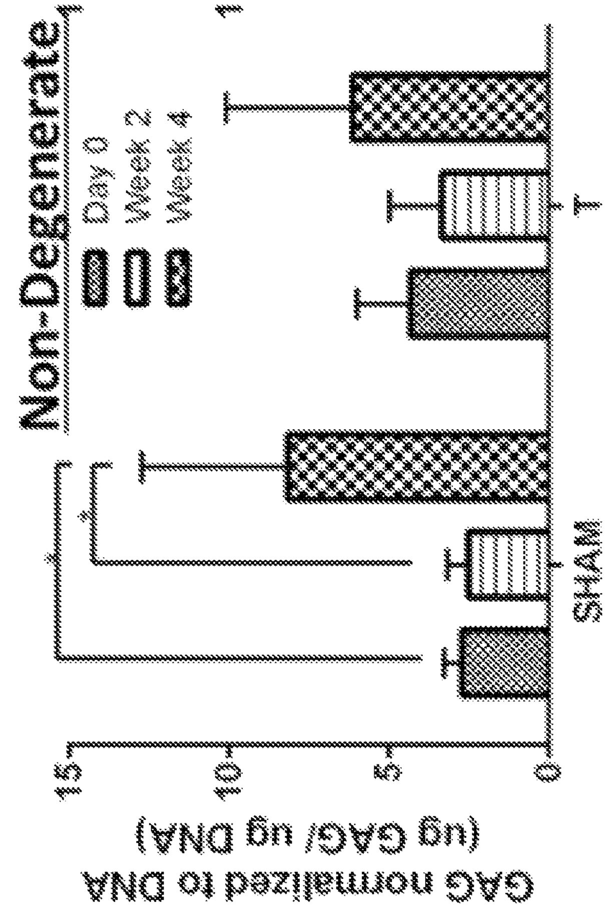

PD cells demonstrated a significant increase in GAG content in BrachT transfected groups at 2 weeks compared to their respective SHAM and this was observed to a lesser extent at week 4 (FIGS. 17A and 17B). Autopsy samples demonstrated an increase in GAG at 4 weeks in SHAM groups with no significant differences in BrachT transfected groups.

DISCUSSION

These results demonstrate that human NP cells can be successfully transfected with transcription factor BrachT and reprogrammed to a healthy NP phenotype with upregulation of key phenotypic markers, enhanced proteoglycan synthesis and down-regulation of inflammatory, catabolic and pain-related markers. High expression of BrachT was maintained over 4 weeks in 3D culture without any detrimental effects on cell viability. ND cells transfected with BrachT demonstrated increases in gene expression for healthy NP marker KRT19, decreases in MMP13 suggesting a decrease in catabolism, decreases in pro-inflammatory and pain genes IL-1β, IL-6, and NGF which all suggest reprogramming towards a 'healthier' IVD phenotype. While similar effects were observed in PD cells this was considered more temporal with peak anabolic effects observed at 2 weeks. Temporal effects suggest further optimization of the delivery system as bulk electroporation involves disruption of the cellular membrane and is less efficient compared to techniques such as engineered vesicles or tissue nanotransfection [Gallego-Perez et al, 2017]. The same temporal effects are seen at week 2 in GAG content with significant increases in GAG compared to the SHAM group at 2 weeks only. In conclusion, this study demonstrated the potential of BrachT to promote a healthy IVD phenotype via transfection into human ND and PD NP cells with increased GAG accumulation.

This is the first study to demonstrate successful reprogramming of diseased human NP cells into healthy NP cells using non-viral transfection of transcription factor BrachT. Further development of this treatment in conjunction with novel, minimally invasive tissue nanotransfection methods has high potential as a regenerative strategy for the treatment of LBP and other musculoskeletal diseases.

Unless defined otherwise, all technical and scientific terms used herein have the same meanings as commonly understood by one of skill in the art to which the disclosed invention belongs. Publications cited herein and the materials for which they are cited are specifically incorporated by reference.

Those skilled in the art will recognize, or be able to ascertain using no more than routine experimentation, many equivalents to the specific embodiments of the invention described herein. Such equivalents are intended to be encompassed by the following claims.

Example 3: Extracellular Vesicle Delivery of Transcription Factors to Reprogram Cells In-Vitro Methods FOXF1 plasmids were expanded and transfected into NP as in cells with culture media collected at 48 hours and extracellular vesicles isolated (Total exosome Isolation Kit). Exosomes were introduced to separate NP cells in monolayer with FOXF1 gene expression assessed at 2 and 7 days. Non-parametric statistical tests were used (Mann-Whitney Tests, $\alpha=0.05$).

Figure 18A:
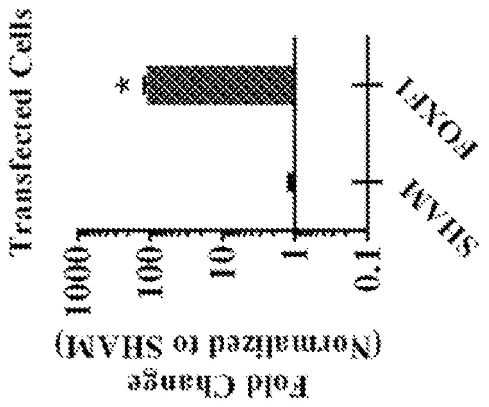
FIGS. 18A to 18C show successful EV generation.
Figure 18B:
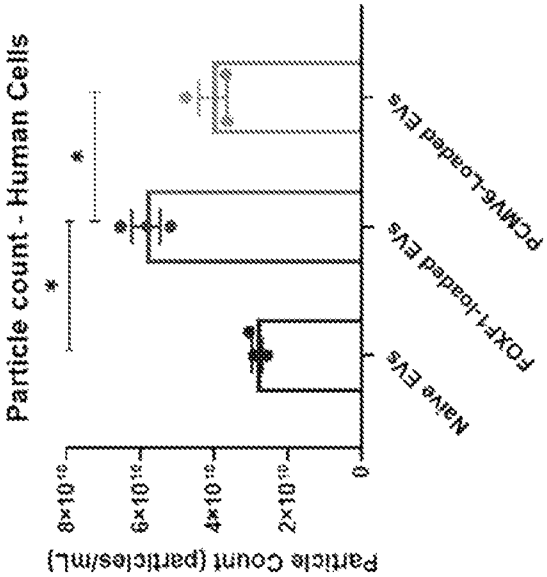
Figure 18C:
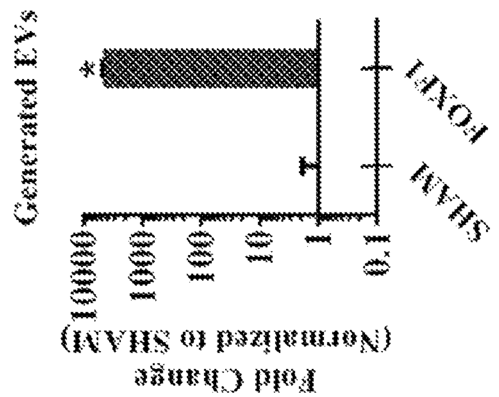
Figure 19A:
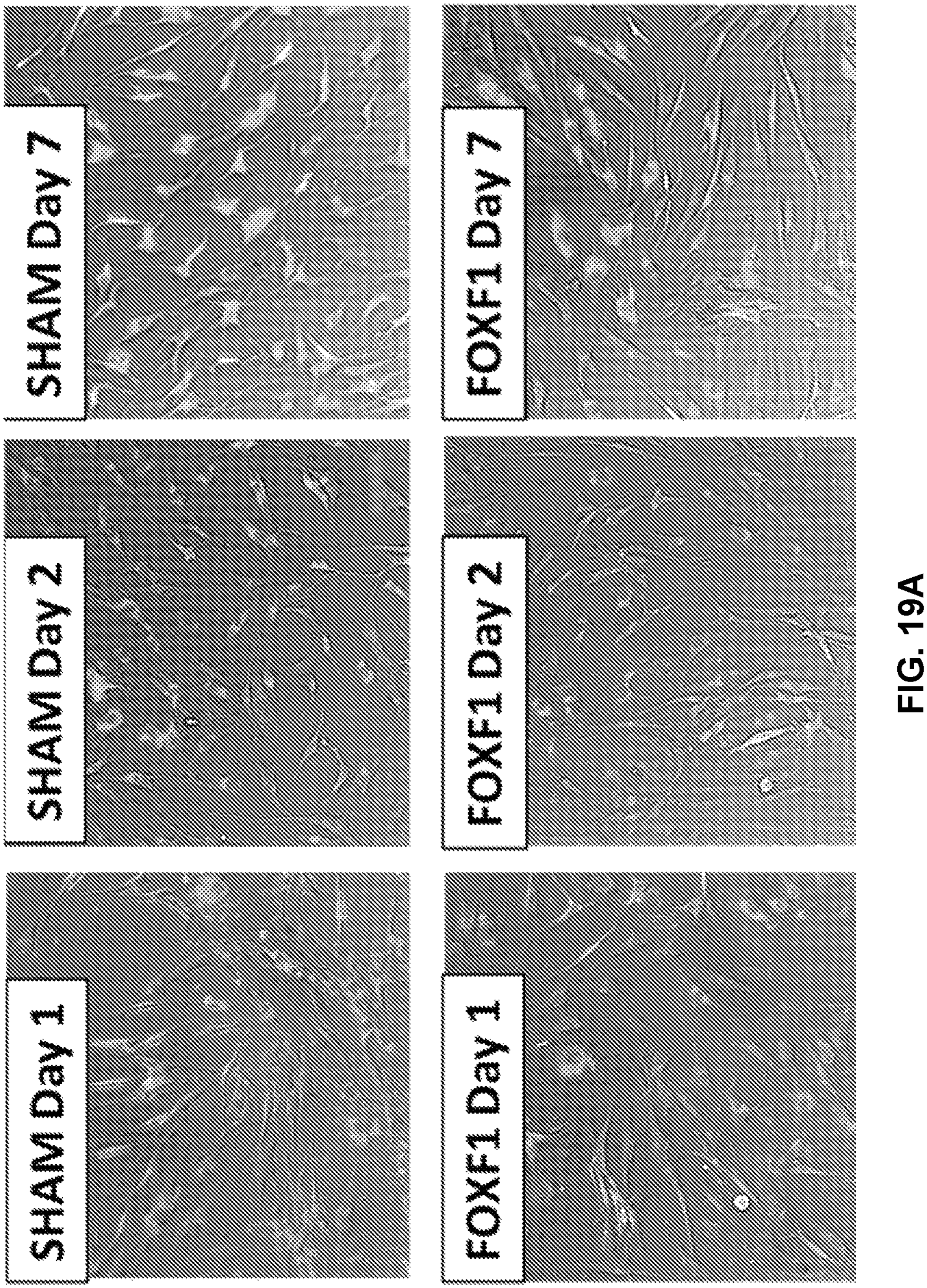
FIGS. 19A to 19C show successful EV uptake by cells.
Figure 19C:
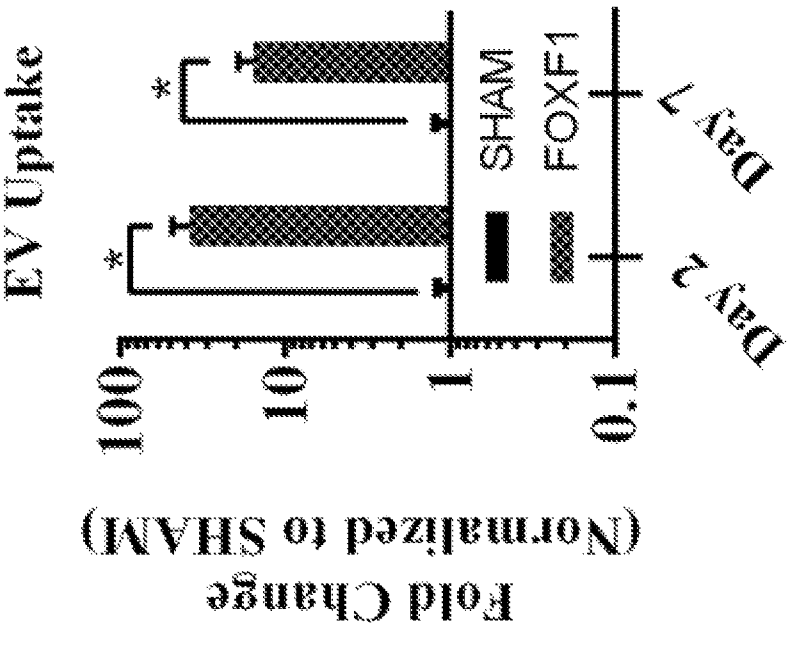
Figure 19B:
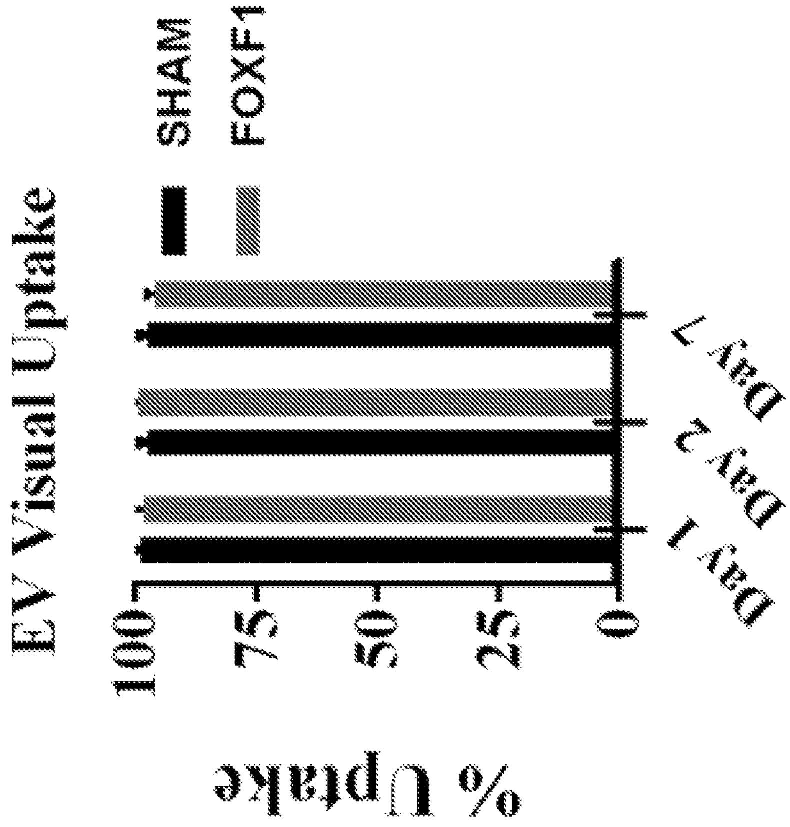

Results: When human EVs labelled with membrane dye PKH26 (red) were incubated with human NP cells in-vitro, uptake of labelled EVs was observed for SHAM and FOXF1 groups (FIG. 19A). In addition, >1000 fold increases in FOXF1 gene expression in FOXF1-EVs compared to SHAM-EVs was also observed. When human NP cells were treated with FOXF1-EVs they demonstrated significant upregulation of FOXF1 at both 2 and 7 days in culture compared to SHAM-EV controls (FIG. 18B,C) Conclusion:

Tagged EVs showed high efficiency in microscopic images and high expression of FOXF1 gene packaged within EVs. Significant upregulation of FOXF1 in FOXF1 EV treated cells implies successful transfection of NP cells using generated EVs. This study demonstrated the potential of FOXF1 to promote a healthy IVD phenotype via transfection into degenerate human NP cells using EVs as a delivery mechanism.

Example 4: Extracellular Vesicle Delivery of Transcription Factors to Reprogram Cells In-Vivo Method: EVs were generated as before and injected into mice lumbar intervertebral disc in-vivo and accessed for 7 days (N=3). In an ongoing study, mice discs were punctured and will be accessed biweekly over 12 and 24 weeks.

Figure 20:
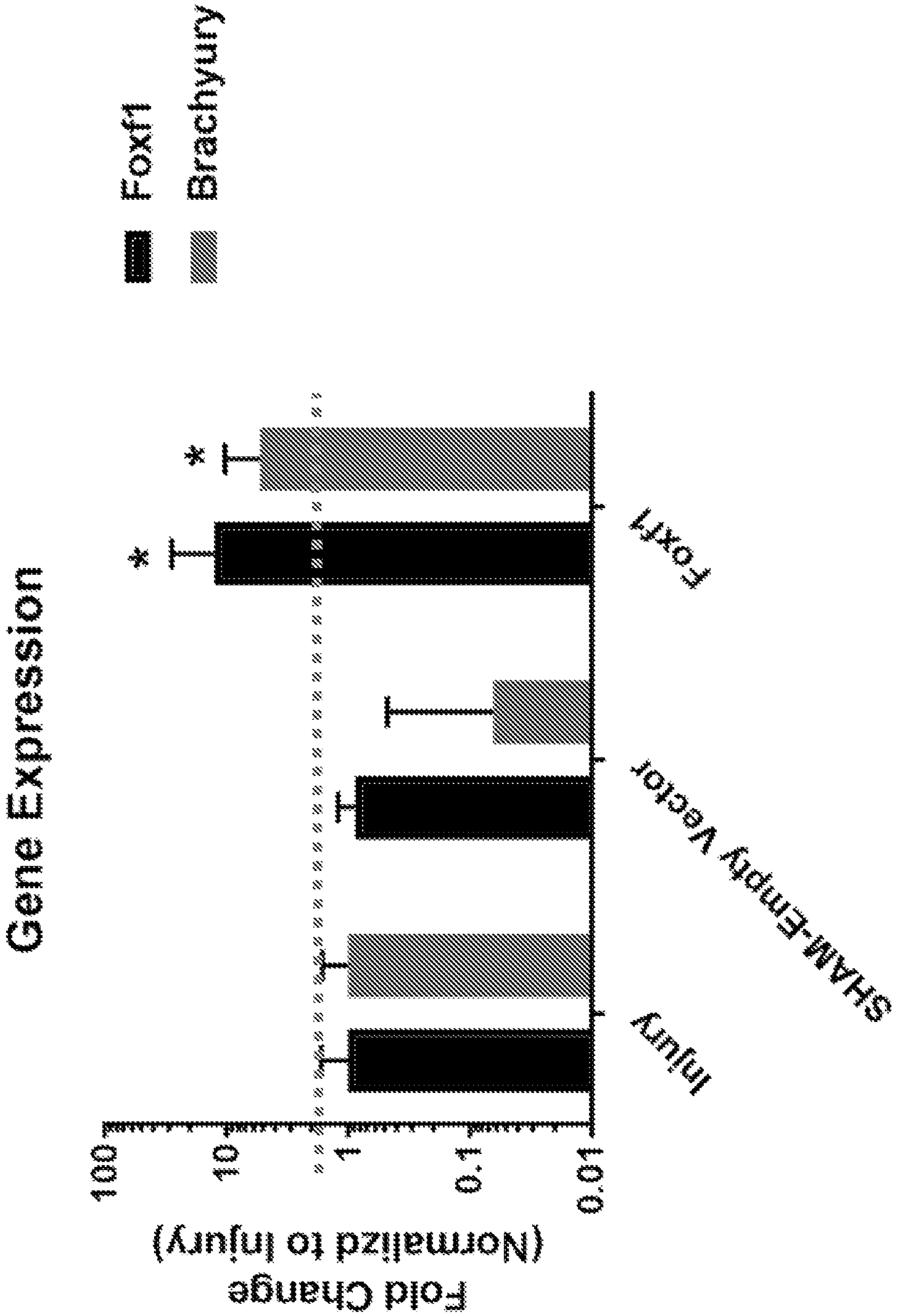
FIG. 20 shows EV delivery in in-vivo lumbar disc puncture mouse model with upregulation of healthy markers.

Results: Viability staining of Mouse disc showed no cytotoxicity compared to non-injected control discs and injected discs showed upregulation of FOXF1 along with healthy NP marker brachyury (FIG. 20)

Figure 21:
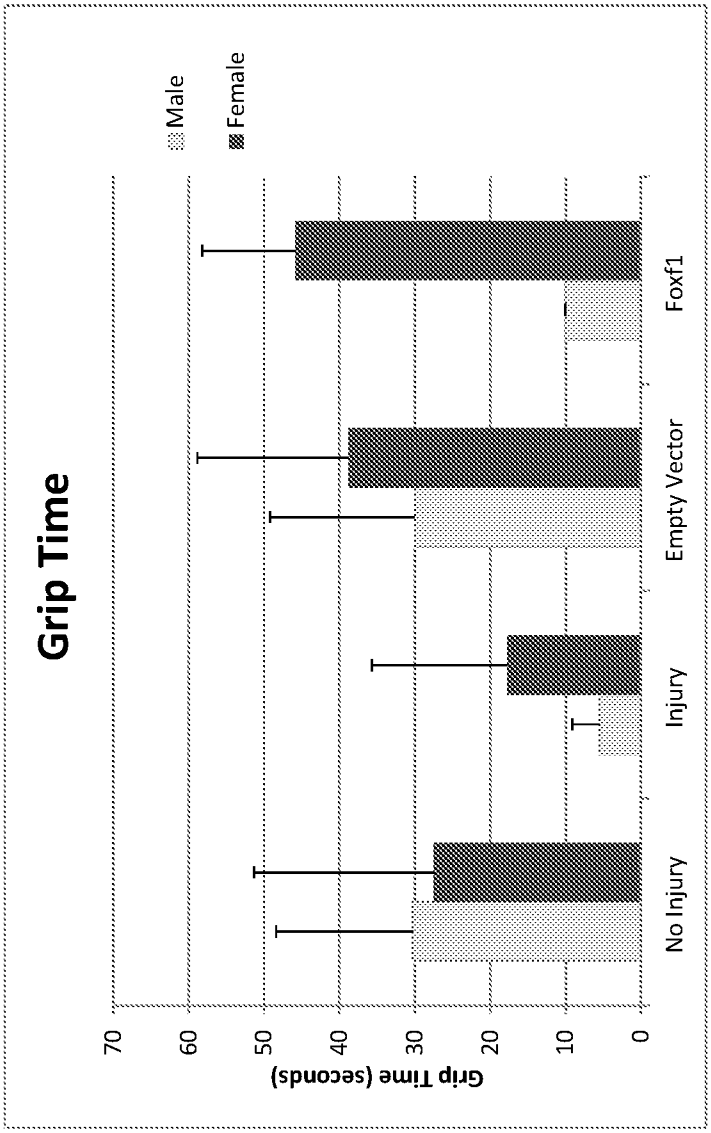
FIG. 21 shows Control (no injury), Injury SHAM, Empty vector injections and FOXF1 injections on Mouse in Vivo showing effects of treatment on mice gripping time indicative of axial strength.

Conclusion: This experiment shows the non-cytotoxic effects of transcription factor delivery via EVs and that the transcription factor successfully integrates into the intervertebral disc space along with upregulation of a healthy marker that was not Injected into the disc. Furthermore, ongoing studies show behavioral differences between injured untreated mice compared to foxf1 treated mice as seen in FIG. 21 where treated mice exhibit longer grip time (indicative of axial strength) compared to injured groups.

SEQUENCE LISTING (310 sequences)

SEQ ID NO: 1 - protein, 379 aa, Homo sapiens
MSSAPEKQQPPHGGGGGGGGGGGAAMDPASSGPSKAKKTNAGIRRPEKPPYSYIALIVMAIQSSPTKRLTLSEIYQFLQSRFPFFRGSYQGWKNSVRHNLSLNECFIKLPKGLGRPGKGHYWTIDPASEFMFEEGSFRRRPRGFRRKCQALKPMYSMMNGLGFNHLPDTYGFQGSAGGLSCPPNSLALEGGLGMMNGHLPGNVDGMALPSHSVPHLPSNGGHSYMGGCGGAAAGEYPHHDSSVPASPLLPTGAGGVMEPHAVYSGSAAAWPPSASAALNSGASYIKQQPLSPCNPAANPLSGSLSTHSLEQPYLHQNSHNAPAELQGIPRYHSQSPSMCDRKEFVFSFNAMASSSMHSAGGGSYYHQQVTYQDIKPCVM

SEQ ID NO: 2 - DNA, 1137 bp, Homo sapiens
atgtcttcggcgcccgagaagcagcagccaccgcacggcggcggcggcggcggcggcgggggaggcggcgcggccatggaccccgcgtcgtccggcccgtccaaggccaagaagaccaacgccggcatccggcgcccggagaagccgccctattcctacatcgcgctcatcgtcatggccatccagagttcacccaccaagcgcctgacgctgagcgagatctaccagttcctgcagagccgcttccccttcttccggggctcctaccagggctggaagaactccgtgcgccacaacctctcgctcaacgagtgcttcatcaagctacccaagggccttgggcggcccggcaagggccactactggaccatcgacccggccagcgagttcatgttcgaggagggctcctttcggcggcggccgcgcggcttccgaaggaaatgccaggcgctcaagcccatgtacagcatgatgaacgggctcggcttcaaccacctcccggacacctacggcttccagggctcggccggcggcctctcgtgcccgcccaacagcctggcgctggagggcggcctgggcatgatgaacggccacttgccgggcaacgtggacggcatggccctgcccagccactcggtgccccacctgccttccaacggcggccactcgtacatgggcggctgcggcggcgcggcggccggcgagtacccgcaccacgacagctcggtgcccgcctccccgctgctgcccaccggcgccggtggggtcatggagccgcacgccgtctactcgggctcggcggcggcctggccgccctcggcgtccgcggcgctcaacagcggcgcctcttatatcaagcagcagcccctgtccccctgtaaccccgcggccaaccccctgtccggcagcctctccacgcactccctggagcagccgtatctgcaccagaacagccacaacgccccagccgagctgcaaggcatcccgcggtatcactcgcagtcgcccagcatgtgtgaccgaaaggagtttgtcttctctttcaacgccatggcgtcctcttccatgcactcggccggcgggggctcctactaccaccagcaggtcacctaccaagacatcaagccttgcgtgatg

SEQ ID NO: 3 - protein, 472 aa, Homo sapiens
MLGTVKMEGHETSDWNSYYADTQEAYSSVPVSNMNSGLGSMNSMNTYMTMNTMTTSGNMTPASFNMSYANPGLGAGLSPGAVAGMPGGSAGAMNSMTAAGVTAMGTALSPSGMGAMGAQQAASMNGLGPYAAAMNPCMSPMAYAPSNLGRSRAGGGGDAKTFKRSYPHAKPPYSYISLITMAIQQAPSKMLTLSEIYQWIMDLFPYYRQNQQRWQNSIRHSLSFNDCFVKVARSPDKPGKGSYWTLHPDSGNMFENGCYLRRQKRFKCEKQPGAGGGGGSGSGGSGAKGGPESRKDPSGASNPSADSPLHRGVHGKTGQLEGAPAPGPAASPQTLDHSGATATGGASELKTPASSTAPPISSGPGALASVPASHPAHGLAPHESQLHLKGDPHYSFNHPFSINNLMSSSEQQHKLDFKAYEQALQYSPYGSTLPASLPLGSASVTTRSPIEPSALEPAYYQGVYSRPVLNTS

SEQ ID NO: 4 - DNA, 1416 bp, Homo sapiens
atgttaggaactgtgaagatggaagggcatgaaaccagcgactggaacagctactacgcagacacgcaggaggcctactcctccgtcccggtcagcaacatgaactcaggcctgggctccatgaactccatgaacacctacatgaccatgaacaccatgactacgagcggcaacatgaccccggcgtccttcaacatgtcctatgccaacccgggcctaggggccggcctgagtcccggcgcagtagccggcatgccggggggctcggcgggcgccatgaacagcatgactgcggccggcgtgacggccatgggtacggcgctgagcccgagcggcatgggcgccatgggtgcgcagcaggcggcctccatgaatggcctgggcccctacgcggccgccatgaacccgtgcatgagccccatggcgtacgcgccgtccaacctgggccgcagccgcgcgggcggcggcggcgacgccaagacgttcaagcgcagctacccgcacgccaagccgccctactcgtacatctcgctcatcaccatggccatccagcaggcgcccagcaagatgctcacgctgagcgagatctaccagtggatcatggacctcttcccctattaccggcagaaccagcagcgctggcagaactccatccgccactcgctgtccttcaatgactgcttcgtcaaggtggcacgctccccggacaagccgggcaagggctcctactggacgctgcacccggactccggcaacatgttcgagaacggctgctacttgcgccgccagaagcgcttcaagtgcgagaagcagccgggggccggcggcgggggcgggagcggaagcgggggcagcggcgccaagggcggccctgagagccgcaaggacccctctggcgcctctaaccccagcgccgactcgcccctccatcggggtgtgcacgggaagaccggccagctagagggcgcgccggcccccgggcccgccgccagcccccagactctggaccacagtggggcgacggcgacagggggcgcctcggagttgaagactccagcctcctcaactgcgccccccataagctccgggcccggggcgctggcctctgtgcccgcctctcacccggcacacggcttggcaccccacgagtcccagctgcacctgaaaggggacccccactactccttcaaccacccgttctccatcaacaacctcatgtcctcctcggagcagcagcataagctggacttcaaggcatacgaacaggcactgcaatactcgccttacggctctacgttgcccgccagcctgcctctaggcagcgcctcggtgaccaccaggagccccatcgagccctcagccctggagccggcgtactaccaaggtgtgtattccagacccgtcctaaacacttcc

SEQ ID NO: 5 - protein, 457 aa, Homo sapiens
MLGAVKMEGHEPSDWSSYYAEPEGYSSVSNMNAGLGMNGMNTYMSMSAAAMGSGSGNMSAGSMNMSSYVGAGMSPSLAGMSPGAGAMAGMGGSAGAAGVAGMGPHLSPSLSPLGGQAAGAMGGLAPYANMNSMSPMYGQAGLSRARDPKTYRRSYTHAKPPYSYISLITMAIQQSPNKMLTLSEIYQWIMDLFPFYRQNQQRWQNSIRHSLSFNDCFLKVPRSPDKPGKGSFWTLHPDSGNMFENGCYLRRQKRFKCEKQLALKEAAGAAGSGKKAAAGAQASQAQLGEAAGPASETPAGTESPHSSASPCQEHKRGGLGELKGTPAAALSPPEPAPSPGQQQQAAAHLLGPPHHPGLPPEAHLKPEHHYAFNHPFSINNLMSSEQQHHHSHHHHQPHKMDLKAYEQVMHYPGYGSPMPGSLAMGPVTNKTGLDASPLAADTSYYQGVYSRPIMNSS

SEQ ID NO: 6 - DNA, 1371 bp, Homo sapiens
atgctgggagcggtgaagatggaagggcacgagccgtccgactggagcagctactatgcagagcccgagggctactcctccgtgagcaacatgaacgccggcctggggatgaacggcatgaacacgtacatgagcatgtcggcggccgccatgggcagcggctcgggcaacatgagcgcgggctccatgaacatgtcgtcgtacgtgggcgctggcatgagcccgtccctggcggggatgtcccccggcgcgggcgccatggcgggcatgggcggctcggccggggcggctggcgtggcgggcatggggccgcacttgagtcccagcctgagcccgctcggggggcaggcggccggggccatgggcggcctggccccctacgccaacatgaactccatgagccccatgtacgggcaggcgggcctgagccgcgcccgcgaccccaagacctacaggcgcagctacacgcacgcaaagccgccctactcgtacatctcgctcatcaccatggccatccagcagagccccaacaagatgctgacgctgagcgagatctaccagtggatcatggacctcttccccttctaccggcagaaccagcagcgctggcagaactccatccgccactcgctctccttcaacgactgtttcctgaaggtgccccgctcgcccgacaagcccggcaagggctccttctggaccctgcaccctgactcgggcaacatgttcgagaacggctgctacctgcgccgccagaagcgcttcaagtgcgagaagcagctggcgctgaaggaggccgcaggcgccgccggcagcggcaagaaggcggccgccggggcccaggcctcacaggctcaactcggggaggccgccgggccggcctccgagactccggcgggcaccgagtcgcctcactcgagcgcctccccgtgccaggagcacaagcgagggggcctgggagagctgaaggggacgccggctgcggcgctgagccccccagagccggcgccctctcccgggcagcagcagcaggccgcggcccacctgctgggcccgccccaccacccgggcctgccgcctgaggcccacctgaagccggaacaccactacgccttcaaccacccgttctccatcaacaacctcatgtcctcggagcagcagcaccaccacagccaccaccaccaccagccccacaaaatggacctcaaggcctacgaacaggtgatgcactaccccggctacggttcccccatgcctggcagcttggccatgggcccggtcacgaacaaaacgggcctggacgcctcgcccctggccgcagatacctcctactaccagggggtgtactcccggcccattatgaactcctct

SEQ ID NO: 7 - protein, 350 aa, Homo sapiens
MLGSVKMEAHDLAEWSYYPEAGEVYSPVTPVPTMAPLNSYMTLNPLSSPYPPGGLPASPLPSGPLAPPAPAAPLGPTFPGLGVSGGSSSSGYGAPGPGLVHGKEMPKGYRRPLAHAKPPYSYISLITMAIQQAPGKMLTLSEIYQWIMDLFPYYRENQQRWQNSIRHSLSFNDCFVKVARSPDKPGKGSYWALHPSSGNMFENGCYLRRQKRFKLEEKVKKGGSGAATTTRNGTGSAASTTTPAATVTSPPQPPPPAPEPEAQGGEDVGALDCGSPASSTPYFTGLELPGELKLDAPYNFNHPFSINNLMSEQTPAPPKLDVGFGGYGAEGGEPGVYYQGLYSRSLLNAS

SEQ ID NO: 8 - DNA, 1050 bp, Homo sapiens
atgctgggctcagtgaagatggaggcccatgacctggccgagtggagctactacccggaggcgggcgaggtctactcgccggtgaccccagtgcccaccatggcccccctcaactcctacatgaccctgaatcctctaagctctccctatccccctggggggctccctgcctccccactgccctcaggacccctggcacccccagcacctgcagcccccctggggcccactttcccaggcctgggtgtcagcggtggcagcagcagctccgggtacggggccccgggtcctgggctggtgcacgggaaggagatgccgaaggggtatcggcggcccctggcacacgccaagccaccgtattcctatatctcactcatcaccatggccatccagcaggcgccgggcaagatgctgaccttgagtgaaatctaccagtggatcatggacctcttcccttactaccgggagaatcagcagcgctggcagaactccattcgccactcgctgtctttcaacgactgcttcgtcaaggtggcgcgttccccagacaagcctggcaagggctcctactgggccctacaccccagctcagggaacatgtttgagaatggctgctacctgcgccgccagaaacgcttcaagctggaggagaaggtgaaaaaagggggcagcggggctgccaccaccaccaggaacgggacagggtctgctgcctcgaccaccacccccgcggccacagtcacctccccgccccagcccccgcctccagcccctgagcctgaggcccagggcggggaagatgtgggggctctggactgtggctcacccgcttcctccacaccctatttcactggcctggagctcccaggggagctgaagctggacgcgccctacaacttcaaccaccctttctccatcaacaacctaatgtcagaacagacaccagcacctcccaaactggacgtggggtttgggggctacggggctgaaggtggggagcctggagtctactaccagggcctctattcccgctctttgcttaatgcatcc

SEQ ID NO: 9 - protein, 325 aa, Homo sapiens
MPRPGRNTYSDQKPPYSYISLTAMAIQSSPEKMLPLSEIYKFIMDRFPYYRENTQRWQNSLRHNLSFNDCFIKIPRRPDQPGKGSFWALHPSCGDMFENGSFLRRRKRFKVLKSDHLAPSKPADAAQYLQQQAKLRLSALAASGTHLPQMPAAAYNLGGVAQPSGFKHPFAIENIIAREYKMPGGLAFSAMQPVPAAYPLPNQLTTMGSSLGTGWPHVYGSAGMIDSATPISMASGDYSAYGVPLKPLCHAAGQTLPAIPVPIKPTPAAVPALPALPAPIPTLLSNSPPSLSPTSSQTATSQSSPATPSETLTSPASALHSVAVH

SEQ ID NO: 10 - DNA, 975 bp, Homo sapiens
atgcctcggcccggccgcaacacgtacagcgaccagaagccgccctactcgtacatctcgctgaccgctatggccatccagagctctcccgagaagatgctgccgctgagcgagatctacaagttcatcatggaccgcttcccctactacagggagaacacgcagcgctggcagaacagtctgcgccacaacctctccttcaacgactgcttcatcaagatcccgcggcggccggaccagccaggcaagggcagcttctgggcgctgcacccaagctgcggggacatgttcgagaacggcagcttcctgcggcgccgcaagcgcttcaaggtgcttaagtccgaccacctggcgcccagcaagccagccgacgcggcgcagtacctgcagcagcaggccaagctgcggctcagcgcgctggcggcctcgggcacgcacctgccacagatgcccgccgccgcctacaacttgggcggcgtggcgcagccctcgggcttcaagcaccccttcgccatcgagaacatcatcgcgcgggaatacaagatgcctggggggctggccttctccgccatgcagccggtgcccgctgcctacccgctccccaaccagttgactaccatgggcagctcgctgggcaccggctggccacacgtgtatggctccgccggcatgatcgactcggccacccccatctccatggcgagtggcgactacagcgcctacggcgtgccgttgaagccgctgtgccacgcggcgggccaaacgctgcccgccatccccgtgcccattaagcccacgccggccgccgtgcccgcgctgcctgcgctgccagcgcccatccccaccttgctctcgaactcgccgccctcgctcagccccacgtcctcgcaaacagccaccagccaaagcagccccgccacccccagcgaaacgctcaccagcccggcctccgccttgcactcggtggcggtgcac

SEQ ID NO: 11 - protein, 432 aa, Homo sapiens
MPRPGKSSYSDQKPPYSYISLTAMAIQHSAEKMLPLSDIYKFIMERFPYYREHTQRWQNSLRHNLSFNDCFIKIPRRPDQPGKGSFWALHPDCGDMFENGSFLRRRKRFKVLRADHTHLHAGSTKSAPGAGPGGHLHPHHHHHPHHHHHHHAAAHHHHHHHPPQPPPPPPPPPPHMVHYFHQQPPTAPQPPPHLPSQPPQQPPQQSQPQQPSHPGKMQEAAAVAAAAAAAAAAAVGSVGRLSQFPPYGLGSAAAAAAAAAASTSGFKHPFAIENIIGRDYKGVLQAGGLPLASVMHHLGYPVPGQLGNVVSSVWPHVGVMDSVAAAAAAAAAAGVPVGPEYGAFGVPVKSLCHSASQSLPAMPVPIKPTPALPPVSALQPGLTVPAASQQPPAPSTVCSAAAASPVASLLEPTAPTSAESKGGSLHSVLVHS

SEQ ID NO: 12 - DNA, 1295 bp, Homo sapiens
atgcctcggcccggcaagtcatcttattctgatcaaaagccaccctactcatatattagcctcacagcgatggctatacagcattcagctgagaagatgttgcctctctccgacatctacaaatcatcatggagcggttcccctactaccgcgaacacacccagcggtggcagaactcacttagacacaacctgagcttcaatgattgttttattaagattcccaggaggccggaccagccaggcaagggttcattctgggcactccaccccgattgcggagacatgtttgaaaacgggagctttctccgacgacggaagagatttaaggtcctgagagccgatcatacccatctccacgccgggtccactaaatctgcaccgggggccggcccaggcgggcatctccatccccaccaccaccatcacccccatcaccatcatcatcaccacgccgctgcacaccaccaccatcaccaccaccccccacaaccaccccctcccccgccacccccgccaccccacatggtccactactttcaccaacagccccccaccgccccgcagcccccgccccacctgccatcacagcccccccagcagcccccacagcaaagccagccccagcaacctagccatcctggtaaaatgcaggaggctgcggcggtggctgcggctgcagctgccgctgctgctgcggctgttgggtctgtgggcagactgagccagttccctccctacggcttgggttccgccgccgcggcggccgccgccgctgcagccagcacttccggctttaagcatccatttgctattgagaacatcattggccgcgactataaaggcgtcctccaagccggaggactcccactcgcgagtgtgatgcatcacttgggctatccagtgccaggccagctgggtaacgtcgtgtcctccgtctggccccacgtgggggtaatggacagtgtggcagcagccgctgccgctgcagctgccgctggcgttccagtaggtcccgaatatggagcattcggcgtgcccgtgaagtccctgtgccactctgcaagccagagcctgccagccatgccggtgcccatcaagccaacaccagccctcccaccagtgtctgccttgcagccaggactcacggtgcccgccgcatctcagcagcctccagcaccctcaacggtgtgcagcgccgcagccgctagccccgtggccagcctcctggaacccactgcacccacatcagctgagtcaaaaggtggaagccttcattccgtgttggtgcactca

SEQ ID NO: 13 - protein, 553 aa, Homo sapiens
MQARYSVSSPNSLGVVPYLGGEQSYYRAAAAAAGGGYTAMPAPMSVYSHPAHAEQYPGGMARAYGPYTPQPQPKDMVKPPYSYIALITMAIQNAPDKKITLNGIYQFIMDRFPFYRDNKQGWQNSIRHNLSLNECFVKVPRDDKKPGKGSYWTLDPDSYNMFENGSFLRRRRRFKKKDAVKDKEEKDRLHLKEPPPPGRQPPPAPPEQADGNAPGPQPPPVRIQDIKTENGTCPSPPQPLSPAAALGSGSAAAVPKIESPDSSSSSLSSGSSPPGSLPSARPLSLDGADSAPPPPAPSAPPPHHSQGFSVDNIMTSLRGSPQSAAAELSSGLLASAAASSRAGIAPPLALGAYSPGQSSLYSSPCSQTSSAGSSGGGGGGAGAAGGAGGAGTYHCNLQAMSLYAAGERGGHLQGAPGGAGGSAVDDPLPDYSLPPVTSSSSSSLSHGGGGGGGGGGQEAGHHPAAHQGRLTSWYLNQAGGDLGHLASAAAAAAAAGYPGQQQNFHSVREMFESQRIGLNNSPVNGNSSCQMAFPSSQSLYRTSGAFVYDCSKF

SEQ ID NO: 14 - DNA, 1659 bp, Homo sapiens
atgcaggcgcgctactccgtgtccagccccaactccctgggagtggtgccctacctcggcggcgagcagagctactaccgcgcggcggccgcggcggccgggggcggctacaccgccatgccggcccccatgagcgtgtactcgcaccctgcgcacgccgagcagtacccgggcggcatggcccgcgcctacgggccctacacgccgcagccgcagcccaaggacatggtgaagccgccctatagctacatcgcgctcatcaccatggccatccagaacgccccggacaagaagatcaccctgaacggcatctaccagttcatcatggaccgcttccccttctaccgggacaacaagcagggctggcagaacagcatccgccacaacctctcgctcaacgagtgcttcgtcaaggtgccgcgcgacgacaagaagccgggcaagggcagctactggacgctggacccggactcctacaacatgttcgagaacggcagcttcctgcggcggcggcggcgcttcaagaagaaggacgcggtgaaggacaaggaggagaaggacaggctgcacctcaaggagccgcccccgcccggccgccagcccccgcccgcgccgccggagcaggccgacggcaacgcgcccggtccgcagccgccgcccgtgcgcatccaggacatcaagaccgagaacggtacgtgcccctcgccgccccagcccctgtccccggccgccgccctgggcagcggcagcgccgccgcggtgcccaagatcgagagccccgacagcagcagcagcagcctgtccagcgggagcagccccccgggcagcctgccgtcggcgcggccgctcagcctggacggtgcggattccgcgccgccgccgcccgcgccctccgccccgccgccgcaccatagccagggcttcagcgtggacaacatcatgacgtcgctgcgggggtcgccgcagagcgcggccgcggagctcagctccggccttctggcctcggcggccgcgtcctcgcgcgcggggatcgcacccccgctggcgctcggcgcctactcgcccggccagagctccctctacagctccccctgcagccagacctccagcgcgggcagctcgggcggcggcggcggcggcgcgggggccgcggggggcgcgggcggcgccgggacctaccactgcaacctgcaagccatgagcctgtacgcggccggcgagcgcgggggccacttgcagggcgcgcccgggggcgcgggcggctcggccgtggacgaccccctgcccgactactctctgcctccggtcaccagcagcagctcgtcgtccctgagtcacggcggcggcggcggcggcggcgggggaggccaggaggccggccaccaccctgcggcccaccaaggccgcctcacctcgtggtacctgaaccaggcgggcggagacctgggccacttggcgagcgcggcggcggcggcggcggccgcaggctacccgggccagcagcagaacttccactcggtgcgggagatgttcgagtcacagaggatcggcttgaacaactctccagtgaacgggaatagtagctgtcaaatggccttcccttccagccagtctctgtaccgcacgtccggagctttcgtctacgactgtagcaagttt

SEQ ID NO: 15 - protein, 501 aa, Homo sapiens
MQARYSVSDPNALGVVPYLSEQNYYRAAGSYGGMASPMGVYSGHPEQYSAGMGRSYAPYHHHQPAAPKDLVKPPYSYIALITMAIQNAPEKKITLNGIYQFIMDRFPFYRENKQGWQNSIRHNLSLNECFVKVPRDDKKPGKGSYWTLDPDSYNMFENGSFLRRRRRFKKKDVSKEKEERAHLKEPPPAASKGAPATPHLADAPKEAEKKVVIKSEAASPALPVITKVETLSPESALQGSPRSAASTPAGSPDGSLPEHHAAAPNGLPGFSVENIMTLRTSPPGGELSPGAGRAGLVVPPLALPYAAAPPAAYGQPCAQGLEAGAAGGYQCSMRAMSLYTGAERPAHMCVPPALDEALSDHPSGPTSPLSALNLAAGQEGALAATGHHHQHHGHHHPQAPPPPPAPQPQPTPQPGAAAAQAASWYLNHSGDLNHLPGHTFAAQQQTFPNVREMFNSHRLGIENSTLGESQVSGNASCQLPYRSTPPLYRHAAPYSYDCTKY

SEQ ID NO: 16 - DNA, 1503 bp, Homo sapiens
atgcaggcgcgctactccgtgtccgaccccaacgccctgggagtggtgccctacctgagcgagcagaattactaccgggctgcgggcagctacggcggcatggccagccccatgggcgtctattccggccacccggagcagtacagcgcggggatgggccgctcctacgcgccctaccaccaccaccagcccgcggcgcctaaggacctggtgaagccgccctacagctacatcgcgctcatcaccatggccatccagaacgcgcccgagaagaagatcaccttgaacggcatctaccagttcatcatggaccgcttccccttctaccgggagaacaagcagggctggcagaacagcatccgccacaacctctcgctcaacgagtgcttcgtcaaggtgccccgcgacgacaagaagcccggcaagggcagttactggaccctggacccggactcctacaacatgttcgagaacggcagcttcctgcggcgccggcggcgcttcaaaaagaaggacgtgtccaaggagaaggaggagcgggcccacctcaaggagccgcccccggcggcgtccaagggcgccccggccaccccccacctagcggacgcccccaaggaggccgagaagaaggtggtgatcaagagcgaggcggcgtccccggcgctgccggtcatcaccaaggtggagacgctgagccccgagagcgcgctgcagggcagcccgcgcagcgcggcctccacgcccgccggctcccccgacggctcgctgccggagcaccacgccgcggcgcccaacgggctgcctggcttcagcgtggagaacatcatgaccctgcgaacgtcgccgccgggcggagagctgagcccgggggccggacgcgcgggcctggtggtgccgccgctggcgctgccctacgccgccgcgccgcccgccgcctacggccagccgtgcgctcagggcctggaggccggggccgccgggggctaccagtgcagcatgcgagcgatgagcctgtacaccggggccgagcggccggcgcacatgtgcgtcccgcccgccctggacgaggccctctcggaccacccgagcggccccacgtcgcccctgagcgctctcaacctcgccgccggccaggagggcgcgctcgccgccacgggccaccaccaccagcaccacggccaccaccacccgcaggcgccgccgcccccgccggctccccagccccagccgacgccgcagcccggggccgccgcggcgcaggcggcctcctggtatctcaaccacagcggggacctgaaccacctccccggccacacgttcgcggcccagcagcaaactttccccaacgtgcgggagatgttcaactcccaccggctggggattgagaactcgaccctcggggagtcccaggtgagtggcaatgccagctgccagctgccctacagatccacgccgcctctctatcgccacgcagccccctactcctacgactgcacgaaatac

SEQ ID NO: 17 - protein, 465 aa, Homo sapiens
MTLSTEMSDASGLAEETDIDVVGEGEDEEDEEEEDDDEGGGGGPRLAVPAQRRRRRRSYAGEDELEDLEEEEDDDDILLAPPAGGSPAPPGPAPAAGAGAGGGGGGGGAGGGGSAGSGAKNPLVKPPYSYIALITMAILQSPKKRLTLSEICEFISGRFPYYREKFPAWQNSIRHNLSLNDCFVKIPREPGNPGKGNYWTLDPESADMFDNGSFLRRRKRFKRQPLLPPNAAAAESLLLRGAGAAGGAGDPAAAAALFPPAPPPPPHAYGYGPYGCGYGLQLPPYAPPSALFAAAAAAAAAAAFHPHSPPPPPPPHGAAAELARTAFGYRPHPLGAALPGPLPASAAKAGGPGASALARSPFSIESIIGGSLGPAAAAAAAAQAAAAAQASPSPSPVAAPPAPGSSGGGCAAQAAVGPAAALTRSLVAAAAAAASSVSSSAALGTLHQGTALSSVENFTARISNC

SEQ ID NO: 18 - DNA, 1395 bp, Homo sapiens
atgaccctgagcactgagatgtccgatgcctctggcctcgccgaggaaacagacatcgacgtggtgggggagggcgaggacgaagaagacgaggaagaggaggacgacgacgagggcggcggtggcgggccccggctggctgtccccgcgcagcggcggcggcggcggcgctcgtacgccggggaggacgagctggaggatctggaggaggaggaggacgacgatgacatcctgctggccccgcctgctgggggctccccggcgcccccgggcccggccccggcggcgggggcaggagccggtgggggcggcggcggcggcggcgcgggcggcggcgggagcgcgggtagcggcgccaagaacccgctggtgaagccgccctactcgtatatcgcgctcatcactatggccatcctgcagagccccaagaagcggctgacgctgagcgagatctgtgagttcatcagcggccgcttcccctactaccgggagaagttccccgcctggcagaacagcatccgccacaacctctcgctcaacgactgcttcgtcaagatcccccgcgagcccggcaacccgggcaagggcaactactggacgctggacccggagtccgccgacatgttcgacaacggcagcttcctgcgccggaggaagcgcttcaagcggcagccgctgctcccacccaacgccgcggccgccgagtctctgctgctgcgcggcgcgggagccgcagggggcgcgggcgacccggcagccgccgccgcgctcttcccgcccgcgcccccgccgcccccgcatgcctacggctacggcccctacggctgcggctacggcctgcagctgccgccttacgcgccgccctcggccctcttcgccgccgcagcggccgccgccgccgccgccgccttccacccgcactcgcccccgccgcccccgccaccgcacggcgcggccgccgagctggcccggaccgccttcggctaccggccgcacccgctcggcgccgccctacccggccccctgccggcctccgcggccaaggcgggcggcccgggcgcctcagcgctggcgcgctcgcccttctccatcgagagcatcatcgggggcagcttgggcccggccgccgctgccgccgccgccgcgcaggccgccgccgccgctcaggcctcgccctcgccctcgccggtggcggcgccgccagctcccggatccagcggaggaggctgcgcggcgcaggcggccgtgggcccggcggccgcgctcacccgatccctcgtggccgccgcggccgccgccgcctcctcagtctcctcgtccgccgccttggggactctgcaccaagggactgccctgtccagtgtcgagaactttactgctaggatttccaattgt

SEQ ID NO: 19 - protein, 495 aa, Homo sapiens
MTLGSCCCEIMSSESSPAALSEADADIDVVGGGSGGGELPARSGPRAPRDVLPHGHEPPAEEAEADLAEDEEESGGCSDGEPRALASRGAAAAAGSPGPGAAAARGAAGPGPGPPSGGAATRSPLVKPPYSYIALITMAILQSPKKRLTLSEICEFISGRFPYYREKFPAWQNSIRHNLSLNDCFVKIPREPGNPGKGNYWTLDPESADMFDNGSFLRRRKRFKRQPLPPPHPHPHPHPELLLRGGAAAAGDPGAFLPGFAAYGAYGYGYGLALPAYGAPPPGPAPHPHPHPHAFAFAAAAAAAPCQLSVPPGRAAAPPPGPPTASVFAGAGSAPAPAPASGSGPGPGPAGLPAFLGAELGCAKAFYPASLSPPAAGTAAGLPTALLRQGLKTDAGGGAGGGGAGAGQRPSFSIDHIMGHGGGGAAPPGAGEGSPGPPFAAAAGPGGQAQVLAMLTAPALAPVAGHIRLSHPGDALLSSGSRFASKVAGLSGCHF

SEQ ID NO: 20 - DNA, 1485 bp, Homo sapiens
atgaccctgggcagctgctgctgcgagatcatgtcctccgagagctccccggccgcgctgtccgaggccgacgcagacatagacgtggtgggcggcggcagcggcgggggggagctcccagctcgctccgggccccgcgccccccgggacgtgctcccccacggccacgagcctcccgcggaggaagccgaggcagacttagccgaggacgaggaggagtctggtggctgctcggacggcgagccccgcgctctggcgtcccggggggcggcggccgcagcggggagcccggggccaggcgccgcggcggcccgcggcgcagcggggcccgggccgggaccgccgtcggggggcgcggcgacgcggagcccgctggtgaagccgccctactcgtacatcgcgctcatcaccatggccatcctgcagagccccaagaagcggctgacgttgagcgagatctgcgagttcatcagcggccgcttcccctactaccgggagaagttccccgcctggcagaacagcatccgccacaacctctctctcaacgactgcttcgtcaagatcccccgcgagccgggcaacccgggcaagggcaactactggacgctggacccggagtcggccgacatgttcgacaacggcagcttcctgcggcgtcgcaagcgcttcaagcggcagcccctgccgccgccgcacccacacccgcaccctcacccggagctgctgctgcgtggcggggccgcggcggcgggggatcccggcgctttcctgcccggcttcgctgcctacggcgcctacggctacggctacgggctggctctcccggcctacggcgcacccccgccggggccggccccgcatccgcacccgcacccgcacgccttcgctttcgccgcggcagccgccgccgctccttgccagctgtcggtacccccaggccgcgccgccgcgcctccacccggacctccgacggcctcggtgttcgcaggcgcgggatcggccccagctcctgcgcctgcctcaggctcgggcccgggcccgggccccgcaggcctgcccgccttcctgggcgcggagctgggctgcgccaaagccttctacccggcgtccctgagtcctcccgcagccggcaccgcggcgggtctgcccaccgcacttctgcgccagggcctcaagacggacgcgggcggtggtgcaggcggcgggggcgccggggcagggcagaggccttccttctctatagaccacatcatgggccacggtggcggcggggcagcacccccgggcgccggcgagggctctccgggaccgccattcgcggcagccgcgggtcctgggggccaagcccaggtcttggccatgctgactgctccggccctggctcccgttgctggccacattcgcctctcgcatcccggggacgcgctgctgtcctcagggtcccggtttgccagcaaagtcgccggccttagtggctgccacttc

SEQ ID NO: 21 - protein, 478 aa, Homo sapiens
MTLSGGGSASDMSGQTVLTAEDVDIDVVGEGDDGLEEKDSDAGCDSPAGPPELRLDEADEVPPAAPHHGQPQPPHQQPLTLPKEAAGAGAGPGGDVGAPEADGCKGGVGGEEGGASGGGPGAGSGSAGGLAPSKPKNSLVKPPYSYIALITMAILQSPQKKLTLSGICEFISNRFPYYREKFPAWQNSIRHNLSLNDCFVKIPREPGNPGKGNYWTLDPQSEDMFDNGSFLRRRKRFKRHQQEHLREQTALMMQSFGAYSLAAAAGAAGPYGRPYGLHPAAAAGAYSHPAAAAAAAAAAALQYPYALPPVAPVLPPAVPLLPSGELGRKAAAFGSQLGPGLQLQLNSLGAAAAAAGTAGAAGTTASLIKSEPSARPSFSIENIIGGGPAAPGGSAVGAGVAGGTGGSGGGSTAQSFLRPPGTVQSAALMATHQPLSLSRTTATIAPILSVPLSGQFLQPAASAAAAAAAAAQAKWPAQ

SEQ ID NO: 22 - DNA, 1434 bp, Homo sapiens
atgaccctctccggcggcggcagcgccagcgacatgtccggccagacggtgctgacggccgaggacgtggacatcgatgtggtgggcgagggcgacgacgggctggaagagaaggacagcgacgcaggttgcgatagccccgcggggccgccggagctgcgcctggacgaggcggacgaggtgcccccggcggcaccccatcacggacagcctcagccgccccaccagcagcccctgacattgcccaaggaggcggccggagccggggccggaccggggggcgacgtgggcgcgccggaggcggacggctgcaagggcggtgttggcggcgaggagggcggcgcgagcggcggcgggcctggcgcgggcagcggttcggcgggaggcctggccccgagcaagcccaagaacagcctagtgaagccgccttactcgtacatcgcgctcatcaccatggccatcctgcagagcccgcagaagaagctgaccctgagcggcatctgcgagttcatcagcaaccgcttcccctactacagggagaagttccccgcctggcagaacagcatccgccacaacctctcactcaacgactgcttcgtcaagatcccccgcgagccgggcaacccgggcaagggcaactactggaccctggacccgcagtccgaggacatgttcgacaacggcagcttcctgcggcgccggaaacgcttcaagcgccaccagcaggagcacctgcgcgagcagacggcgctcatgatgcagagcttcggcgcttacagcctggcggcggcggccggcgccgcgggaccctacggccgcccctacggcctgcaccctgcggcggcggccggtgcctattcgcacccggcagcggcggcggccgcggctgctgcggcggcgctccagtacccgtacgcgctgccgccggtggcaccggtgctgcctcccgctgtgccgctgctgccctcgggcgagctgggccgcaaagcggccgccttcggctcacagctcggcccgggcctgcagctgcagctcaatagcctgggcgccgccgcggccgctgcgggcacagcgggcgccgcgggcaccaccgcgtcgctcatcaagtccgagccaagcgcgcggccgtcgttcagcatcgagaacatcataggtgggggccccgcggctcctgggggctcggcggtgggcgctggggtcgccggcggcactgggggttcagggggcggcagcacggcgcagtcgtttctgcggccacccgggaccgtgcagtcggcagcgctcatggccacccaccaaccgctgtcgctgagccggacgactgccaccatcgcgcccattcttagcgtgccactctccggacagtttctgcagcccgcagcctcggccgccgccgctgctgcggccgccgctcaagccaaatggccggcgcaa

SEQ ID NO: 23 - protein, 439 aa, Homo sapiens
MNLPRAERLRSTPQRSLRDSDGEDGKIDVLGEEEDEDEEEAASQQFLEQSLQPGLQVARWGGVALPREHIEGGGGPSDPSEFGTEFRAPPRSAAASEDARQPAKPPSSYIALITMAILQSPHKRLTLSGICAFISDRFPYYRRKFPAWQNSIRHNLSLNDCFVKIPREPGRPGKGNYWSLDPASQDMFDNGSFLRRRKRFQRHQPTPGAHLPHPFPLPAAHAALHNPRPGPLLGAPAPPQPVPGAYPNTGPGRRPYALLHPHPPRYLLLSAPAYAGAPKKAEGADLATPAPFPCCSPHLVLSLGRRARVWRRHREADASLSALRVSCKGSGERVQGLRRVCPRPRGATAPCSSDRQACRTILQQQQRHQEEDCANGCAPTKGAVLGGHLSAASALLRYQAVAEGSGLTSLAAPLGGEGTSPVFLVSPTPSSLAESAGPS

SEQ ID NO: 24 - DNA, 1317 bp, Homo sapiens
atgaacttgccaagagctgagcgccttcgctccacaccgcagcgcagcctccgggactccgatggggaagacggtaaaatcgatgtcctgggagaggaggaagatgaagacgaggaggaggcggcgagccagcagttcctagagcagtcgctccagccggggctgcaggtggcccggtggggcggggttgcgcttccccgagagcacatcgagggcggcggcggcccgagcgacccctcagagtttggcaccgagttcagggcaccgccaaggtctgcggcggcctctgaagatgcccggcagccggcaaagcccccctcctcgtacatcgcgctcatcaccatggccatcctgcaaagcccgcacaagcgcctcacgctcagcggcatctgcgccttcattagtgaccgcttcccctactaccgccgcaagttccccgcctggcagaacagcatccgccacaacctctcgctgaacgactgcttcgtcaagatcccccgcgagccgggccgcccaggcaagggcaactactggagcctggaccccgcctcccaggacatgttcgacaatggcagctttctccggcgtaggaagcgtttccagcgccaccaaccgaccccgggagcccacctgccccaccccttccctctacctgctgcacacgccgccctgcacaacccccgcccaggccctctgcttggggcccctgccccgccgcagccagtcccgggggcctaccccaacaccggccccgggagacgcccttacgctctgctgcacccgcatcctcctcgctacctactgctctcggcccccgcctatgccggggcaccgaagaaagcagaaggcgcggacctggcgaccccggcacccttcccgtgctgcagccctcacttggtcctcagccttgggaggagggcaagggtctggcgtcgccaccgggaggcggatgcatctctttcagcattgagagtatcatgcaaggggtcaggggagcgggtacaggggctgcgcagagtttgtccccgaccgcgtggagctactgccccctgctccagcgaccgtcaagcctgtcggacaattttgcagcaacagcagcggcatcaggaggaggactgcgccaacggctgcgctcccaccaagggcgcggtgctgggcgggcacctgtcggccgcgtcggcgctgctgcggtatcaggcggtggcagagggctctgggctgacatcgctggccgcccctttgggcggagaggggacctcaccagtttttttagtatcgcccacgcccagttccctggccgagtccgcagggccctcc

SEQ ID NO: 25 - protein, 408 aa, Homo sapiens
MNLPRAERPRSTPQRSLRDSDGEDGKIDVLGEEEDEDEVEDEEEEASQKFLEQSLQPGLQVARWGGVALPREHIEGGGPSDPSEFGTEFRAPPRSAAASEDARQPAKPPYSYIALITMAILQSPHKRLTLSGICAFISGRFPYYRRKFPAWQNSIRHNLSLNDCFVKIPREPGHPGKGTYWSLDPASQDMFDNGSFLRRRKRFKRHQLTPGAHLPHPFPLPAAHAALHNPRPGPLLGAPALPQPVPGAYPNTAPGRRPYALLHPHPPRYLLLSAPAYAGAPKKAEGADLATPGTLPVLQPSLGPQPWEEGKGLASPPGGGCISFSIESIMQGVRGAGTGAAQSLSPTAWSYCPLLQRPSSLSDNFAATAAASGGGLRQRLRSHQGRGAGRAPVGRVGAAAVSGGGRGL

SEQ ID NO: 26 - DNA, 2067 bp, Homo sapiens
atctttgccggacgttgttgcaaaggagtagaaacaagcagaggaaaacatcccaaagggtaaccactagcgttcctgcttcttgcaacattcatcccaggcttccagctcagcccgccccgggccaggtgatcggccgccacatcccctgcgactgaagcacctgctccgccatgaacctgccaagagctgagcgccctcgctccacaccgcagcgcagcctccgggactccgatggggaagacggtaaaatcgatgtcctgggagaggaggaagatgaagacgaggtggaagacgaggaggaggaggcgagccagaagttcctagagcagtcgctccagccggggctgcaggtggcccggtggggcggggttgcgcttccccgagagcacatcgagggcggcggcccgagcgacccctcagagtttggcaccgagttcagggcaccgccaaggtctgcggcggcctctgaagatgcccggcagccggcaaagcccccctactcgtacatcgcgctcatcaccatggccatcctgcaaagcccgcacaagcgcctcacgctcagcggcatctgcgccttcattagtggccgcttcccctactaccgccgcaagttccccgcctggcagaacagcatccgccacaacctctcgctgaacgactgcttcgtcaagatcccccgcgagccgggccacccaggcaagggcacctactggagcctggaccccgcctcccaggacatgttcgacaatggcagctttctccggcgtaggaagcgtttcaagcgccaccaactgaccccgggagcccacctgccccaccccttccctctacctgctgcacacgccgccctgcacaacccccgcccaggccctctgcttggggcccctgccctgccgcagccagtcccgggggcctaccccaacaccgcccccgggagacgcccttacgctctgctgcacccgcatcctcctcgctacctactgctctcggcccccgcctatgccggggcaccgaagaaagcagaaggcgcggacctggcgacccccggcacccttcccgtgctgcagccctcacttggtcctcagccttgggaggagggcaagggtctggcgtcgccaccgggaggcggatgcatctctttcagcattgagagtatcatgcaaggggtcaggggagcgggtacaggggctgcgcagagtttgtccccgaccgcgtggagctactgccccctgctccagcgaccgtcaagcctgtcggacaattttgcagcaacagcagcagcatcaggaggaggactgcgccaacggctgcgctcccaccaagggcgcggtgctgggcgggcacctgtcggccgcgtcggcgctgctgcggtatcaggcggtggcagagggctctaggctgacatcgctggctgcccctttgggcggagaggggacctcaccagtttttttagtatcgcccacgcccagttccctggccaagtccgcagggccctcctagagccaggtgggagtggggagcgatccgcagctgctcactccaccttgcgcggcccatactgggcgtgtgcatctgaatcctgctggagagcaaacacgaacttctgttccctgcaaaatggttagaaagaaacagctggattacgttcctctaaaaaccacctgaacgtaaccttcgcagggcgtcaagtcatcttttcttgccttcggctgtggcttctgtggctttccggatttgcacatttcctggggtactatgaacgtgagtggggtattttgttctggcattagaagaaaaacaagcaagcaaacaaaaacacagcctccgatgccaaacatgttcccccttcttcacttccttggaactggaagtgttattcctaagtctagtgcaaaatgcttctactctctgtgtcttcctgatagggatgtttaatgtaagtaggatattaatttcagaacattgatttcttatctgtgtgtctgacgtgccatctttaatgttaaaattaaggtgttaaaattaagcctagttatatagacgaaataaaatgctaagtcacta

SEQ ID NO: 27 - protein, 359 aa, Homo sapiens
MNLPRAERLRSTPQRSLRDSDGEDGKIDVLGEEEDEDEVEDEEEAASQQFLEQSLQPGLQVARWGGVALPREHIEGGGGPSDPSEFGTKFRAPPRSAAASEDARQPAKPPYSYIALITMAILQNPHKRLTLSGICAFISGRFPYYRRKFPAWQNSIRHNLSLNDCFVKIPREPGHPGKGNYWSLDPASQDMFDNGSFLRRRKRFKRHQLTPGAHLPHPFPLPAAHAALHNPRPGPLLGAPAPPQPVPGAYPNTAPGRRPYALLHPHPLRYLLLSAPVYAGAPKKAEGAALATPAPFPCCSPHLVLSLGRRARVWRRHREADASLSALRVLCKGSRTAPTAALPPRARCWAGTCRPRRPC

SEQ ID NO: 28 - DNA, 2218 bp, Homo sapiens
cattcatcccaggcttccagctcagcccgccccaggccaggtgatcggccgccacatcccctgcgactgaagcacctgctcctccatgaacctgccaagagctgagcgccttcgctccacaccgcagcgcagcctccgggactccgatggggaagacggtaaaatcgatgtcctgggagaggaggaagatgaagacgaggtggaagacgaggaggaggcggcgagccagcagttcctagagcagtcgctccagccggggctgcaggtggcccggtggggcggggttgcgcttccccgagagcacatcgagggcggcggcggcccgagcgacccctcagagtttggcaccaagttcagggcaccgccaaggtctgcggcggcctctgaagatgcccggcagccggcaaagcccccctactcgtacatcgcgctcatcaccatggccatcctgcaaaacccgcacaagcgcctcacgctcagcggcatctgcgccttcattagtggccgcttcccctactaccgccgcaagttccccgcctggcagaacagcatccgccacaacctctcgctgaacgactgcttcgttaagatcccccgcgagccgggccacccaggcaagggcaactactggagcctggaccccgcctcccaagacatgttcgacaatggcagctttctccggcgtaggaagcgtttcaagcgccaccaactgaccccgggagcccacctgccccaccccttccctctacctgctgcacacgccgccctgcacaacccccgcccaggccctctgcttggggcccctgccccgccgcagccagtcccgggggcctaccccaacaccgcccccgggagacgcccttacgctctgctgcacccgcatcctcttcgctacctactgctctcggcccccgtctatgccggggcaccgaagaaagcagaaggcgcggccctggcgaccccggcacccttcccgtgctgcagccctcacttggtcctcagccttgggaggagggcaagggtctggcgtcgccaccgggaggcggatgcatctctttcagcattgagagtattatgcaaggggtcaggggagcgggtacaggggctgcgcagaatttgtccccgaccgcgtggagctactgccacctgctccagcgaccatcaagcctgttgcatccccagaccgctgcccctttgctgcaagtgtccgccgccgccgctgctcggacaattttgcagcaatagcagcagcatcaggaggaggactgcgccaacggctgcgctcccaccaagggcgcggtgctgggcgggcacctgtcggcctcgtcggccctgctgaggtatcaggcagtggcagagggctctaggctgacatcgctggctgcccctttgggcggagaggggacctcaccagtttttttagtatcgcccacgcccagttccctggccaactccgcagggccctcctagagccaggtgggagtggggagcgacccgcagctgctcactccaccttgcgcggcccatactgggcgtgtgcatctgaatcccgctggagagcaaacacgaacttctgttcgctgcaaaatggttagaaagaaacagctggattacgttcctctaaaaaccacctgaacgtaaccttcgcagggcgtcaagtcatcttttcttgccttcggttgtggcttctatggctgtcccgatttgcgcatttcctggggtactatgaacgtgagtggggtattttgttctggcattaaaagaaaaacaagcaagcaaacaaaaacacagcctccgatgccaaacatgttcccccttcttcacttccttggagctggaagtattattcctaagtctagtgcaaaatgcttctactctctgtgtcttcctgatagggatgtttaatgtaagtaggatattaatttcagaacattgatttcttatctgtgtgtctgacgtgccatctttaatgttaaaattaaggtgttaaaattaagcctagttatatagacgaaataaaatgctaagtcactacactacatcgtttattttctattacatctcattcttccctttctaaatggaactttttaaaacctacgttattttccctcaaacaatttattttcacaattcatatttattatagatagcagaagtaatccattttaatatggcctttaaaaattccaaatatttgaggttgaaaatgtcctgg

SEQ ID NO: 29 - protein, 373 aa, Homo sapiens
MTAESGPPPPQPEVLATVKEERGETAAGAGVPGEATGRGAGGRRRKRPLQRGKPPYSYIALIAMAIAHAPERRLTLGGIYKFITERFPFYRDNPKKWQNSIRHNLTLNDCFLKIPREAGRPGKGNYWALDPNAEDMFESGSFLRRRKRFKRSDLSTYPAYMHDAAAAAAAAAAAAAAAAIFPGAVPAARPPYPGAVYAGYAPPSLAAPPPVYYPAASPGPCRVFGLVPERPLSPELGPAPSGPGGSCAFASAGAPATTTGYQPAGCTGARPANPSAYAAAYAGPDGAYPQGAGSAIFAAAGRLAGPASPPAGGSSGGVETTVDFYGRTSPGQFGALGACYNPGGQLGGASAGAYHARHAAAYPGGIDRFVSAM

SEQ ID NO: 30 - DNA, 1118 bp, Homo sapiens
atgactgccgagagcgggccgccgccgccgcagccggaggtgctggctaccgtgaaggaagagcgcggcgagacggcagcaggggccggggtcccaggggaggccacgggccgcggggcgggcgggcggcgccgcaagcgccccctgcagcgcgggaagccgccctacagctacatcgcgctcatcgccatggccatcgcgcacgcgcccgagcgccgcctcacgctgggcggcatctacaagttcatcaccgagcgcttccccttctaccgcgacaaccccaaaaagtggcagaacagcatccgccacaacctcacactcaacgactgcttcctcaagatcccgcgcgaggccggccgcccgggtaagggcaactactgggcgcttgaccccaacgcggaggacatgttcgagagcggcagcttcctgcgccgccgcaagcgcttcaagcgctcggacctctccacctacccggcttacatgcacgacgcggcggctgccgcagccgccgccgccgccgccgccgccgccgccgccatcttcccaggcgcggtgcccgccgcgcgccccccctacccgggcgccgtctatgcaggctacgcgccgccgtcgctggccgcgccgcctccagtctactaccccgcggcgtcgcccggcccttgccgcgtcttcggcctggttcctgagcggccgctcagcccagagctggggcccgcaccgtcggggcccggcggctcttgcgcctttgcctccgccgggcccccgctaccaccaccggctaccagcccgcaggctgcaccggggcccggccggccaacccctccgcctatgcggctgcctacgcgggccccgacggcgcgtacccgcagggcgccggcagtgcgatctttgccgctgctggccgcctggcgggacccgcttcgcccccagcgggcggcagcagtggcggcgtggagaccacggtggacttctacgggcgcacgtcgcccggccagttcggagcgctgggagcctgctacaaccctggcgggcagctcggaggggccagtgcaggcgcctaccatgctcgccatgctgccgcttatcccggtgggatagatcggttcgtgtccgccatg

SEQ ID NO: 31 - protein, 319 aa, Homo sapiens
MAGRSDMDPPAAFSGFPALPAVAPSGPPPSPLAGAEPGREPEEAAAGRGEAAPTPAPGPGRRRRRPLQRGKPPYSYIALIAMALAHAPGRRLTLAAIYRFITERFAFYRDSPRKWQNSIRHNLTLNDCFVKVPREPGNPGKGNYWTLDPAAADMFDNGSFLRRRKRFKRAELPAHAAAAPGPPLPFPYAPYAPAPGPALLVPPPSAGPGPSPPARLFSVDSLVNLQPELAGLGAPEPPCCAAPDAAAAAFPPCAAAASPPLYSQVPDRLVLPATRPGPGPLPAEPLLALAGPAAALGPLSPGEAYLRQPGFASGLERYL

SEQ ID NO: 32 - DNA, 957 bp, Homo sapiens
atggcggggcgcagcgacatggatccgcccgccgcgttctctggcttccctgccctgccagcggtcgcgccgtcggggccgccgccgtcgccgctcgcaggagccgagccagggcgggagccagaggaggcggcggctggccgcggagaggcggcccccacgcccgcgcccggcccggggcggcggcggcggcggcccctgcagcgcgggaagccgccctactcgtacatcgcgctcatcgccatggctctggcgcacgccccgggccgccgcctcacgctggccgccatctaccgcttcatcaccgaacgctttgccttctaccgcgacagcccgcgcaagtggcagaacagcatccgccacaatctcacgctcaacgactgcttcgtcaaggtgccccgcgagccgggcaacccgggcaagggcaactactggacgctggaccccgcggccgcagacatgttcgacaacggcagcttcctgcggcgccgcaagcgcttcaagcgcgccgagctgcccgcgcacgcggccgcggcgccagggccgccgctccccttcccctacgcgccctacgcgcccgcgcccggccccgcgctgctggtgccgccgccttctgccggaccgggcccctcgccgcccgcgcgtctgttcagcgtcgacagcctggtgaacctgcagccggagctagcggggctgggcgcccccgagccgccctgctgcgccgcgcccgacgccgcagccgcagccttcccgccctgcgctgccgccgcctccccgccactctactcgcaggtccccgaccgcctggtactgcccgcgacgcgccccggccccggcccgctgcccgctgagcccctcctggccttggccgggccggcagccgctctcggcccgctcagccctggggaggcctacctgaggcagccgggcttcgcgtcggggctggagcgctacctg

SEQ ID NO: 33 - protein, 489 aa, Homo sapiens
MLDMGDRKEVKMIPKSSFSINSLVPEAVQNDNHHASHGHHNSHHPQHHHHHHHHHHHPPPPAPQPPPPPQQQQPPPPPPPAPQPPQTRGAPAADDDKGPQQLLLPPPPPPPPAAALDGAKAVGLGGKGEPGGGPGELAPVGPDEKEKGAGAGGEEKKGAGEGGKDGEGGKEGEKKNGKYEKPPFSYNALIMMAIRQSPEKRLTLNGIYEFIMKNFPYYRENKQGWQNSIRHNLSLNMCFVKVPRHYDDPGKGNYWMLDPSSDDVFIGGTTGKLRRRSTTSRAKLAFKRGARLTSTGLTFMDRAGSLYWPMSPFLSLHHPRASSTLSYNGTTSAYPSHPMPYSSVLTQNSLGNNHSFSTANGLSVDRLVNGEIPYATHHLTAAALAASVPCGLSVPCSGTYSLNPCSVNLLAGQTSYFFPHVPHPSMTSQSSTSMSARATSSSTSPQAPSTLPCESLRPSLPSFTTGLSGGLSDYFTHQNQGSSSNPLIH

SEQ ID NO: 34 - DNA, 1467 bp, Homo sapiens
atgctggacatgggagataggaaagaggtgaaaatgatccccaagtcctcgttcagcatcaacagcctggtgcccgaggcggtccagaacgacaaccaccacgcgagccacggccaccacaacagccaccacccccagcaccaccaccaccaccaccaccatcaccaccacccgccgccgcccgccccgcaaccgccgccgccgccgcagcagcagcagccgccgccgccgccgcccccggcaccgcagcccccccagacgcggggcgccccggccgccgacgacgacaagggcccccagcagctgctgctcccgccgccgccaccgccaccaccggccgccgccctggacggggctaaagcggtcgggctgggcggcaagggcgagccgggcggcgggccgggggagctggcgcccgtcgggccggacgagaaggagaagggcgccggcgccgggggggaggagaagaagggggcgggcgagggcggcaaggacggggaggggggcaaggagggcgagaagaagaacggcaagtacgagaagccgccgttcagctacaacgcgctcatcatgatggccatccggcagagccccgagaagcggctcacgctcaacggcatctacgagttcatcatgaagaacttcccttactaccgcgagaacaagcagggctggcagaactccatccgccacaatctgtccctcaacatgtgcttcgtgaaggtgccgcgccactacgacgacccgggcaagggcaactactggatgctggacccgtcgagcgacgacgtgttcatcggcggcaccacgggcaagctgcggcgccgctccaccacctcgcgggccaagctggccttcaagcgcggtgcgcgcctcacctccaccggcctcaccttcatggaccgcgccggctccctctactggcccatgtcgcccttcctgtccctgcaccacccccgcgccagcagcactttgagttacaacggcaccacgtcggcctaccccagccaccccatgccctacagctccgtgttgactcagaactcgctgggcaacaaccactccttctccaccgccaacggcctgagcgtggaccggctggtcaacggggagatcccgtacgccacgcaccacctcacggccgccgcgctagccgcctcggtgccctgcggcctgtcggtgccctgctctgggacctactccctcaacccctgctccgtcaacctgctcgcgggccagaccagttactttttcccccacgtcccgcacccgtcaatgacttcgcagagcagcacgtccatgagcgccagggccacgtcctcctccacgtcgccgcaggccccctcgaccctgccctgtgagtctttaagaccctctttgccaagttttacgacgggactgtctgggggactgtctgattatttcacacatcaaaatcaggggtcttcttccaaccctttaatacat

SEQ ID NO: 35 - protein, 365 aa, Homo sapiens
MGPCSGSRLGPPEAESPSQPPKRRKKRYLRHDKPPYTYLAMIALVIQAAPSRRLKLAQIIRQVQAVFPFFREDYEGWKDSIRHNLSSNRCFRKVPKDPAKPQAKGNFWAVDVSLIPAEALRLQNTALCRRWQNGGARGAFAKDLGPYVLHGRPYRPPSPPPPPSEGFSIKSLLGGSGEGAPWPGLAPQSSPVPAGTGNSGEEAVPTPPLPSSERPLWPLCPLPGPTRVEGETVQGGAIGPSTLSPEPRAWPLHLLQGTAVPGGRSSGGHRASLWGQLPTSYLPIYTPNVVMPLAPPPTSCPQCPSTSPAYWGVAPETRGPPGLLCDLDALFQGVPPNKSIYDVWVSHPRDLAAPGPGWLLSWCSL

SEQ ID NO: 36 - DNA, 1095 bp, Homo sapiens
atggggccctgcagcggctcccgcctggggcccccagaggcagagtcgccctcccagccccctaagaggaggaagaagaggtacctgcgacatgacaagcccccctacacctacttggccatgatcgccttggtgattcaggccgctccctcccgcagactgaagctggcccagatcatccgtcaggtccaggccgtgttccccttcttcagggaagactacgagggctggaaagactccattcgccacaacctttcctccaaccgatgcttccgcaaggtgcccaaggaccctgcaaagccccaggccaagggcaacttctgggcggtcgacgtgagcctgatcccagctgaggcgctccggctgcagaacaccgccctgtgccggcgctggcagaacggaggtgcgcgtggagccttcgccaaggacctgggcccctacgtgctgcacggccggccataccggccgcccagtcccccgccaccacccagtgagggcttcagcatcaagtccctgctaggagggtccggggagggggcaccctggccggggctagctccacagagcagcccagttcctgcaggcacagggaacagtggggaggaggcggtgcccaccccaccccttccctcttctgagaggcctctgtggcccctctgcccccttcctggccccacgagagtggagggggagactgtgcaggggggagccatcgggccctcaaccctctccccagagcctagggcctggcctctccacttactgcagggcaccgcagttcctgggggacggtccagcgggggacacagggcctccctctgggggcagctgcccacctcctacttgcctatctacactcccaatgtggtaatgcccttggcaccaccacccacctcctgtccccagtgtccgtcaaccagccctgcctactggggggtggcccctgaaacccgagggcccccagggctgctctgcgatctagacgccctcttccaaggggtgccacccaacaaaagcatctacgacgtttgggtcagccaccctcgggacctggcggcccctggcccaggctggctgctctcctggtgcagcctg

SEQ ID NO: 37 - protein, 378 aa, Homo sapiens
MSSFDLPAPSPPRCSPQFPSIGQEPPEMNLYYENFFHPQGVPSPQRPSFEGGGEYGATPNPYLWFNGPTMTPPPYLPGPNASPFLPQAYGVQRPLLPSVSGLGGSDLGWLPIPSQEELMKLVRPPYSYSALIAMAIHGAPDKRLTLSQIYQYVADNFPFYNKSKAGWQNSIRHNLSLNDCFKKVPRDEDDPGKGNYWTLDPNCEKMFDNGNFRRKRKRKSDVSSSTASLALEKTESSLPVDSPKTTEPQDILDGASPGGTTSSPEKRPSPPPSGAPCLNSFLSSMTAYVSGGSPTSHPLVTPGLSPEPSDKTGQNSLTFNSFSPLTNLSNHSGGGDWANPMPTNMLSYGGSVLSQFSPHFYNSVNTSGVLYPREGTEV

SEQ ID NO: 38 - DNA, 1134 bp, Homo sapiens
atgagctccttcgacctgccggcgccctccccacctcgctgcagcccccagttccccagcatcggccaggagccccccgagatgaacctctactatgagaacttcttccacccacagggcgtgcccagccctcagcggccctccttcgaggggggcggcgagtatggggccacccccaacccctacctctggttcaacgggcccaccatgaccccgccaccctacctgcccggccccaacgccagccccttcctgccccaggcctatggagtgcagagaccgctgctgcccagcgtgtcggggcttggggggagcgacctgggctggctgcccatcccctcgcaggaggagctgatgaagctggtgcggccaccctattcctactcggctctcatcgccatggccatccacggggcacccgacaagcgcctcactctcagccagatctaccagtacgtggccgacaacttccccttctacaacaagagcaaggccggctggcagaactccatccgccacaacctgtcgctcaacgactgcttcaagaaggtgccccgcgacgaggacgacccgggcaaagggaattactggaccctggaccccaactgtgagaaaatgttcgacaatggaaatttccgcaggaaaaggaagagaaaatcagatgtttcctctagcacagcctccttggccttagagaagacagagagcagtctcccggtggacagccccaagaccacggagcctcaggacatcttggatggagcctcaccagggggcaccaccagctccccagagaagcggccctcccctcccccatcaggcgccccttgccttaacagcttcctttcctctatgacagcctatgtgagcggggggagccccacgagccaccccttggtcacaccaggactgagccctgagcccagtgacaagacggggcagaactcactgaccttcaactccttctccccgctcaccaacctcagcaaccacagcggtgggggtgactgggcgaaccccatgcccaccaacatgctcagctacggaggatctgtgctcagccaattcagccctcacttctacaacagtgtcaacaccagtggtgtcctctaccccagggagggcaccgaggtc

SEQ ID NO: 39 - protein, 420 aa, Homo sapiens
MAESWLRLSGAGPAEEAGPEGGLEEPDALDDSLTSLQWLQEFSILNAKAPALPPGGTDPHGYHQVPGSAAPGSPLAADPACLGQPHTPGKPTSSCTSRSAPPGLQAPPPDDVDYATNPHVKPPYYATLICMAMQASKATKITLSAIYKWITDNFCYFRHADPTWQNSIRHNLSLNKCFIKVPREKDEPGKGGFWRIDPQYAERLLSGAFKKRRLPPVHIHPAFARQAAQEPSAVPRAGPLTVNTEAQQLLREFEEATGEAGWGAGEGRLGHKRKQPLPKRVAKVPRPPSTLLPTPEEQGELEPLKGNFDWEAIFDAGTLGGELGALEALELSPPLSPASHVDVDLTIHGRHIDCPATWGPSVEQAADSLDFDETFLATSFLQHPWDESGSGCLPPEPLFEAGDATLASDLQDWASVGAFL

SEQ ID NO: 40 - DNA, 1263 bp, Homo sapiens
atggcggagagctggctgcgcctctcgggagccgggccggcggaggaggccgggccggagggcggcctggaggagcccgacgccctggatgacagcctgaccagcctgcagtggctgcaggaattctccattctcaacgccaaggcccccgccctgcccccggggggcaccgacccccacggctaccaccaggtgccaggttcagcggcgcccgggtcccccctggcggccgaccccgcctgcctggggcagccacacacgccgggcaagcccacgtcgtcgtgcacgtcgcggagcgcgcccccggggctgcaggccccaccccccgacgacgtggactacgccaccaatccgcacgtgaagcctccctactcgtatgccacgctcatctgcatggccatgcaggccagcaaggccaccaagatcaccctgtcggccatctacaagtggatcacggacaacttctgctacttccgccacgcagatcccacctggcagaattcaatccgccacaacctgtctctgaacaagtgcttcatcaaagtgcctcgggagaaggacgaaccaggcaaggggggcttctggcgcattgacccccagtacgcggagcggctactgagcggcgctttcaagaagcggcgactgccccctgtccacatccacccagcctttgcccgccaggccgcgcaggagcccagcgctgtcccccgggccgggccgctgacggtgaataccgaggcccagcagctgctgcgggagttcgaggaggccaccggggaggcgggctggggtgcaggcgagggcaggctggggcataagcgcaaacagccgctgcccaagcgggtggccaaggtcccgcggccccccagcaccctgctgcccaccccggaggagcagggtgagctggaacccctcaaaggcaactttgactgggaggccatcttcgacgccggcactctgggcggggagctgggtgcactggaggccctggagctgagcccgcctctgagccccgcctcacacgtggacgtggacctcaccatccacggccgccacatcgactgccctgccacctgggggccttcggtggagcaggctgccgacagcctggacttcgatgagaccttcctggccacatccttcctgcagcacccctgggacgagagcggcagtggctgcctgcccccggagcccctctttgaggctggggatgccaccctggcctccgacctgcaggactgggccagcgtgggggccttcttg

SEQ ID NO: 41 - protein, 733 aa, Homo sapiens
MAEVGEDSGARALLALRSAPCSPVLCAAAAAAAFPAAAPPPAPAQPQPPPGPPPPPPPPLPPGAIAGAGSSGGSSGVSGDSAVAGAAPALVAAAAASVRQSPGPALARLEGREFEFLMRQPSVTIGRNSSQGSVDLSMGLSSFISRRHLQLSFQEPHFYLRCLGKNGVFVDGAFQRRGAPALQLPKQCTFRFPSTAIKIQFTSLYHKEEAPASPLRPLYPQISPLKIHIPEPDLRSMVSPVPSPTGTISVPNSCPASPRGAGSSSYRFVQNVTSDLQLAAEFAAKAASEQQADTSGGDSPKDESKPPFSYAQLIVQAISSAQDRQLTLSGIYAHITKHYPYYRTADKGWQNSIRHNLSLNRYFIKVPRSQEEPGKGSFWRIDPASEAKLVEQAFRKRRQRGVSCFRTPFGPLSSRSAPASPTHPGLMSPRSGGLQTPECLSREGSPIPHDPEFGSKLASVPEYRYSQSAPGSPVSAQPVIMAVPPRPSSLVAKPVAYMPASIVTSQQPAGHAIHVVQQAPTVTMVRVVTTSANSANGYILTSQGAAGGSHDAAGAAVLDLGSEARGLEEKPTIAFATIPAAGGVIQTVASQMAPGVPGHTVTILQPATPVTLGQHHLPVRAVTQNGKHAVPTNSLAGNAYALTSPLQLLATQASSSAPVVVTRVCEVGPKEPAAAVAATATTTPATATTASASASSTGEPEVKRSRVEEPSGAVTTPAGVIAAAGPQGPGTGE

SEQ ID NO: 42 - DNA, 2199 bp, Homo sapiens
atggccgaagtcggcgaggacagcggcgcccgcgccctgctcgcgctgcgctcggcgccctgcagcccagtgctgtgcgccgcagccgccgccgccgccttccccgcggccgcacccccgccggcccccgcgcagccccagcctccgcccgggccgccgccgccgccgccaccgccgctgcctccgggcgcgatcgcgggcgcgggctcctccgggggctcctccggggtatccggggactccgcggtcgcgggcgcggcgccggccctggtggccgcggcggccgcctcggtacggcagagcccggggccggcgctggcgcggctggagggccgcgagttcgagttcctcatgcgccagcccagcgtcaccatcggccgcaactcgtcgcagggctcggtggacttgagcatgggcctgtccagcttcatctcgcggcgccacctgcagctcagcttccaggagccgcacttctacctgcgctgcctcggcaagaacggcgtcttcgtggacggggccttccagagacgcggcgcgcccgccctgcagctgcccaagcagtgtaccttccggtttcccagcacggccatcaagatccagttcacgtcgctctatcacaaagaagaggccccagcctccccgctgcggccactgtacccccagatctcccctctgaagatccacatcccggagccggacctccggagcatggtcagccccgtcccctccccgacgggcaccatcagtgtccccaactcctgcccagccagtccacgcggtgccggctcctccagttaccgctttgtgcagaacgtgacctcggacctgcagctggcagcagagtttgcagcaaaggccgcgtcggagcagcaggcagacacgtctggaggagacagccccaaggatgagtcaaagccgccgttctcctacgcgcagctgatcgtgcaggccatctcctccgcccaggaccggcagctgaccctgagcgggatctacgcccacatcaccaagcattacccctactaccggacggccgacaaaggctggcagaattctatccggcacaacctctctttgaaccgttactttatcaaagtcccacgttcccaggaggagcctgggaaggggtccttttggcgaatagaccctgcctctgaagccaagctcgtggaacaggcattccggaaacggaggcagaggggtgtctcctgcttccgcacccccttcgggcctctgtcctcaaggagcgctccagcttcgcccacacaccccgggctgatgtcccctcgctccggcggcctgcagaccccagagtgcctgtctcgggagggctcccccattccacacgaccctgagtttgggtccaagttagcttctgtcccagagtaccggtattcccaaagcgcacccggctcccccgtcagcgcccagccagtgatcatggccgtgcctccccgaccgtccagcctcgtggccaagcccgtggcctacatgcccgcctccatcgtaacctcacagcagcccgcgggccacgccatccacgtcgtgcagcaggcccccaccgtcaccatggtcagggtggtcaccacatctgccaactcggccaacggatacatcctcaccagccagggcgcggcggggggctcccatgatgcggcgggcgcagccgtgctggacctgggcagcgaggccagaggcctggaggagaaacccaccattgcgtttgccacaatccccgcggctggtggagtcatccagacggtggccagccagatggcccccggggtccccggacacacggtcaccatcctgcagcccgccacacccgtgaccctcgggcagcaccaccttccagtccgggccgtgacccagaacggaaagcatgcggttcccacgaacagtttagccggcaacgcttacgccctcaccagccctttgcagctccttgcgacccaagcgagttcatccgcgccggtggtggtcacccgggtgtgcgaggtggggcccaaggagccagcagcagccgtcgcggccacggccaccaccaccccagccactgccaccaccgcctctgcctccgcctcttccactggagagcccgaggtcaaaaggtcccgggtggaggagcccagtggggctgtaaccacaccggctggagtgatcgcagctgccggcccccaggggccaggcaccggggag

SEQ ID NO: 43 - protein, 345 aa, Homo sapiens
MSHLFDPRLPALAASPMLYLYGPERPGLPLAFAPAAALAASGRAETPQKPPYSYIALIAMAIQDAPEQRVTLNGIYQFIMDRFPFYHDNRQGWQNSIRHNLSLNDCFVKVPREKGRPGKGSYWTLDPRCLDMFENGNYRRRKRKPKPGPGAPEAKRPRAETHQRSAEAQPEAGSGAGGSGPAISRLQAAPAGPSPLLDGPSPPAPLHWPGTASPNEDAGDAAQGAAAVAVGQAARTGDGPGSPLRPASRSSPKSSDKSKSFSIDSILAGKQGQKPPSGDELLGGAKPGPGGRLGASLLAASSSLRPPFNASLMLDPHVQGGFYQLGIPFLSYFPLQVPDTVLHFQ

SEQ ID NO: 44 - DNA, 1035 bp, Homo sapiens
atgagtcacctcttcgatccccggctgcctgccctggccgcctcgcccatgctgtatctgtacggtcccgagagacccggcctccctctggccttcgcccccgcggctgctctagctgcctcgggccgggccgagaccccgcagaagcctccctacagctacatcgcgctcatcgccatggcgatccaggacgcgcccgagcagagggtcacgctcaacggcatctaccagttcatcatggaccgcttccccttctaccacgacaaccggcagggctggcagaacagcatccgccacaacctctcgctcaacgactgcttcgtcaaggtgccccgcgagaaagggcggccgggcaagggcagctactggacgctggacccccgctgcctggacatgtttgagaacggcaactaccggcgccggaagaggaagcccaagccgggccccggggccccggaggccaagaggccccgcgccgagacgcaccagcgcagcgcggaggcgcagccggaggcggggagcggggcagggggctcgggccccgcaatctcccgcctgcaggcagcgcccgcgggcccctcgcccctcctggacggcccctctccgccggcgcccctccactggccggggaccgcgtccccgaacgaggacgctggtgacgctgcccagggcgcagcggccgtggcggtcggccaggcagcgcgcacaggggacggcccggggtcccctctgcgccccgcctcccgcagctctccgaagagctccgacaagtccaagagcttcagcatagacagcatcctggcgggaaagcagggccagaagccgccttcaggggacgaactcctagggggtgccaagcctgggcccggcggccgtctgggtgcctcgctcctggccgcctcctccagcctccgtccgcctttcaacgcttccctgatgctcgacccgcatgtccagggcggcttttaccagctcgggatccccttcctctcttatttccccctgcaggttcccgacacggtactccacttccag

SEQ ID NO: 45 - protein, 376 aa, Homo sapiens
MMASYPEPEDAAGALLAPETGRTVKEPEGPPPSPGKGGGGGGGTAPEKPDPAQKPPYSYVALIAMAIRESAEKRLTLSGIYQYIIAKFPFYEKNKKGWQNSIRHNLSLNECFIKVPREGGGERKGNYWTLDPACEDMFEKGNYRRRRRMKRPFRPPPAHFQPGKGLFGAGGAAGGCGVAGAGADGYGYLAPPKYLQSGFLNNSWPLPQPPSPMPYASCQMAAAAAAAAAAAAAAGPGSPGAAAVVKGLAGPAASYGPYTRVQSMALPPGVVNSYNGLGGPPAAPPPPPHPHPHPHAHHLHAAAAPPPAPPHHGAAAPPPGQLSPASPATAAPPAPAPTSAPGLQFACARQPELAMMHCSYWDHDSKTGALHSRLDL

SEQ ID NO: 46 - DNA, 1128 bp, Homo sapiens
atgatggccagctaccccgagcccgaggacgcggcgggggccctgctggccccagagaccggtcgcacagtcaaggagccagaagggccgccgccgagcccaggcaagggcggtgggggtggcggcgggacagccccggagaagccggacccggcgcagaagcccccgtactcgtacgtggcgctcatcgccatggcgatccgcgagagcgcggagaagaggctcacgctgtccggcatctaccagtacatcatcgcgaagttcccgttctacgagaagaataagaagggctggcaaaatagcatccgccacaacctcagcctcaacgagtgcttcatcaaggtgccgcgcgagggcggcggcgagcgcaagggcaactactggacgctggacccggcctgcgaagacatgttcgagaagggcaactaccggcgccgccgccgcatgaagaggcccttccggccgccgcccgcgcacttccagcccggcaaggggctcttcggggccggaggcgccgcaggcgggtgcggcgtggcgggcgccggggccgacggctacggctacctggcgccccccaagtacctgcagtctggcttcctcaacaactcgtggccgctaccgcagcctccctcacccatgccctatgcctcctgccagatggcggcagccgcagcggctgcagcagctgcggctgcagccgcgggccccggtagccctggcgcggccgctgtggtcaaggggctggcgggcccggccgcctcgtacgggccgtacacacgcgtgcagagcatggcgctgccccccggcgtagtgaactcgtacaatggcctgggaggcccgccggccgcacccccgcctccgccgcacccccacccgcatccgcacgcacaccatctgcacgcggccgccgcaccgccgcctgccccaccgcaccacggggccgccgcgccgccgccgggccagctcagccctgccagcccagccaccgccgcgcccccggcgcccgcgcccaccagtgcgccgggcctgcagttcgcttgtgcccggcagcccgagctcgccatgatgcattgctcttactgggaccacgacagcaagaccggcgcgctgcattcgcgcctcgatctc

SEQ ID NO: 47 - protein, 763 aa, Homo sapiens
MKTSPRRPLILKRRRLPLPVQNAPSETSEEEPKRSPAQQESNQAEASKEVAESNSCKFPAGIKIINHPTMPNTQVVAIPNNANIHSIITALTAKGKESGSSGPNKFILISCGGAPTQPPGLRPQTQTSYDAKRTEVTLETLGPKPAARDVNLPRPPGALCEQKRETCADGEAAGCTINNSLSNIQWLRKMSSDGLGSRSIKQEMEEKENCHLEQRQVKVEEPSRPSASWQNSVSERPPYSYMAMIQFAINSTERKRMTLKDIYTWIEDHFPYFKHIAKPGWKNSIRHNLSLHDMFVRETSANGKVSFWTIHPSANRYLTLDQVFKPLDPGSPQLPEHLESQQKRPNPELRRNMTIKTELPLGARRKMKPLLPRVSSYLVPIQFPVNQSLVLQPSVKVPLPLAASLMSSELARHSKRVRIAPKVLLAEEGIAPLSSAGPGKEEKLLFGEGFSPLLPVQTIKEEEIQPGEEMPHLARPIKVESPPLEEWPSPAPSFKEESSHSWEDSSQSPTPRPKKSYSGLRSPTRCVSEMLVIQHRERRERSRSRRKQHLLPPCVDEPELLFSEGPSTSRWAAELPFPADSSDPASQLSYSQEVGGPFKTPIKETLPISSTPSKSVLPRTPESWRLTPPAKVGGLDFSPVQTSQGASDPLPDPLGLMDLSTTPLQSAPPLESPQRLLSSEPLDLISVPFGNSSPSDIDVPKPGSPEPQVSGLAANRSLTEGLVLDTMNDSLSKILLDISFPGLDEDPLGPDNINWSQFIPELQ

SEQ ID NO: 48 - DNA, 2289 bp, Homo sapiens
atgaaaactagcccccgtcggccactgattctcaaaagacggaggctgccccttcctgttcaaaatgccccaagtgaaacatcagaggaggaacctaagagatcccctgcccaacaggagtctaatcaagcagaggcctccaaggaagtggcagagtccaactcttgcaagtttccagctgggatcaagattattaaccaccccaccatgcccaacacgcaagtagtggccatccccaacaatgctaatattcacagcatcatcacagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtgcagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaagaactccatccgccacaacctttccctgcacgacatgtttgtccgggagacgtctgccaatggcaaggtctccttctggaccattcaccccagtgccaaccgctacttgacattggaccaggtgtttaagccactggacccagggtctccacaattgcccgagcacttggaatcacagcagaaacgaccgaatccagagctccgccggaacatgaccatcaaaaccgaactccccctgggcgcacggcggaagatgaagccactgctaccacgggtcagctcatacctggtacctatccagttcccggtgaaccagtcactggtgttgcagccctcggtgaaggtgccattgcccctggcggcttccctcatgagctcagagcttgcccgccatagcaagcgagtccgcattgcccccaaggtgctgctagctgaggaggggatagctcctctttcttctgcaggaccagggaaagaggagaaactcctgtttggagaagggttttctcctttgcttccagttcagactatcaaggaggaagaaatccagcctggggaggaaatgccacacttagcgagacccatcaaagtggagagccctcccttggaagagtggccctccccggccccatctttcaaagaggaatcatctcactcctgggaggattcgtcccaatctcccaccccaagacccaagaagtcctacagtgggcttaggtccccaacccggtgtgtctcggaaatgcttgtgattcaacacagggagaggagggagaggagccggtctcggaggaaacagcatctactgcctccctgtgtggatgagccggagctgctcttctcagaggggcccagtacttcccgctgggccgcagagctcccgttcccagcagactcctctgaccctgcctcccagctcagctactcccaggaagtgggaggaccttttaagacacccattaaggaaacgctgcccatctcctccaccccgagcaaatctgtcctccccagaacccctgaatcctggaggctcacgcccccagccaaagtagggggactggatttcagcccagtacaaacctcccagggtgcctctgaccccttgcctgaccccctggggctgatggatctcagcaccactcccttgcaaagtgctcccccccttgaatcaccgcaaaggctcctcagttcagaacccttagacctcatctccgtcccctttggcaactcttctccctcagatatagacgtccccaagccaggctccccggagccacaggtttctggccttgcagccaatcgttctctgacagaaggcctggtcctggacacaatgaatgacagcctcagcaagatcctgctggacatcagctttcctggcctggacgaggacccactgggccctgacaacatcaactggtcccagtttattcctgagctacag

SEQ ID NO: 49 - protein, 648 aa, Homo sapiens
MVSLPPPQSDVTLPGPTRLEGERQGDLMQAPGLPGSPAPQSKHAGFSCSSFVSDGPPERTPSLPPHSPRIASPGPEQVQGHCPAGPGPGPFRLSPSDKYPGFGFEEAAASSPGRFLKGSHAPFHPYKRPFHEDVFPEAETTLALKGHSFKTPGPLEAFEEIPVDVAEAEAFLPGFSAEAWCNGLPYPSQEHGPQVLGSEVKVKPPVLESGAGMFCYQPPLQHMYCSSQPPFHQYSPGGGSYPIPYLGSSHYQYQRMAPQASTDGHQPLFPKPIYSYSILIFMALKNSKTGSLPVSEIYNFMTEHFPYFKTAPDGWKNSVRHNLSLNKCFEKVENKSGSSSRKGCLWALNPAKIDKMQEELQKWKRKDPIAVRKSMAKPEELDSLIGDKREKLGSPLLGCPPPGLSGSGPIRPLAPPAGLSPPLHSLHPAPGPIPGKNPLQDLLMGHTPSCYGQTYLHLSPGLAPPGPPQPLFPQPDGHLELRAQPGTPQDSPLPAHTPPSHSAKLLAEPSPARTMHDTLLPDGDLGTDLDAINPSLTDFDFQGNLWEQLKDDSLALDPLVLVTSSPTSSSMPPPQPPPHCFPPGPCLTETGSGAGDLAAPGSGGSGALGDLHLTTLYSAFMELEPTPPTAPAGPSVYLSPSSKPVALA

SEQ ID NO: 50 - DNA, 1944 bp, Homo sapiens
atggtgtcgctacccccgccgcagtctgacgtcacgctgccgggccccaccagactggagggcgagcgccaaggggacctcatgcaggcaccgggcctcccaggctcccctgccccacagagtaagcatgccggcttcagctgctcgtcatttgtgtccgacggccctccagagaggacaccctcactgcccccacacagcccccgcattgcgtcaccagggcccgagcaagtccagggccactgcccagccggccccggccctgggcccttcaggctctcaccctcagacaagtatcctggctttggctttgaggaggccgcagcaagcagccctgggcgattcctcaagggcagccacgcgcccttccacccgtacaagcggcctttccatgaggacgtcttcccagaggccgagaccaccctggccctcaaaggacactcctttaagaccccagggccgctggaggccttcgaggagatcccagtggacgtggcggaggccgaggccttcctgcctggcttctcagcagaggcctggtgtaacgggctcccctaccccagccaggagcatggcccccaagtcctgggttcagaggtcaaagtcaagcccccagttctggagagtggtgctgggatgttctgctaccagcctcccttgcagcatatgtactgctcctcccagccccccttccaccagtactcgccaggtggtggcagctaccccataccctacctgggctcctcacactatcagtaccagcgaatggcaccccaggccagcaccgatgggcaccagcctctcttcccaaaacccatctattcctacagcatcctcatcttcatggcccttaagaacagtaaaactgggagccttcccgtcagcgagatctacaattttatgacggagcactttccttacttcaagacagcacccgatggctggaagaattctgtccggcacaacctatccctcaacaagtgcttcgagaaggtggagaacaaatcaggaagttcctcccgcaagggctgcctgtgggccctcaatccggccaagatcgacaagatgcaagaggagctgcaaaaatggaagaggaaagatcccattgctgtgcgcaaaagcatggccaagccagaagagctggacagcctcattggagacaagagagaaaagctgggctccccactcctgggctgtccgccccctgggctgtccggctcaggccccatccggcccctggcacccccagctggcctctccccaccactgcactcactccacccagctccaggccccattcctggcaagaaccccctgcaggacctacttatggggcacacaccctcctgctatgggcagacatacttgcacctctcaccaggcctggcccctcctggacccccgcagccattgttcccacagccggacgggcaccttgagctgcgggcccagccaggcaccccccaggactcgcctctgcctgcccacaccccacccagccacagtgccaagctactggccgagccttccccagccaggactatgcacgacaccctgctgccagatggagaccttggcactgacctggatgccatcaatccctcactcactgacttcgacttccagggaaacctgtgggaacagttgaaggatgatagcttggccctcgaccccctggtactggtgacctcatccccgacatcatcttcgatgccaccaccccagccaccacctcactgcttcccccctgggccctgtctgacagagacaggcagtggggcaggtgacttggcagccccgggcagtggtggctccggggcactgggtgacctgcacctcaccaccctctactctgcctttatggagctggagcccacgccccccacggcccctgcaggcccctctgtgtacctcagccccagctccaagcccgtggccctggca

SEQ ID NO: 51 - protein, 431 aa, Homo sapiens
MGPVIGMTPDKRAETPGAEKIAGLSQIYKMGSLPEAVDAARPKATLVDSESADDELTNLNWLHESTNLLTNFSLGSEGLPIVSPLYDIEGDDVPSFGPACYQNPEKKSATSKPPYSFSLLIYMAIEHSPNKCLPVKEIYSWILDHFPYFATAPTGWKNSVRHNLSLNKCFQKVERSHGKVNGKGSLWCVDPEYKPNLIQALKKQPFSSASSQNGSLSPHYLSSVIKQNQVRNLKESDIDAAAAMMLLNTSIEQGILECEKPLPLKTALQKKRSYGNAFHHPSAVRLQESDSLATSIDPKEDHNYSASSMAAQRCASRSSVSSLSSVDEVYEFIPKNSHVGSDGSEGFHSEEDTDVDYEDDPLGDSGYASQPCAKISEKGQSGKKMRKQTCQEIDEELKEAAGSLLHLAGIRTCLGSLISTAKTQNQKQRKK

SEQ ID NO: 52 - DNA, 1293 bp, Homo sapiens
atgggtccagtaattggaatgactccagataagagagctgaaaccccaggagctgaaaagattgcaggattaagccagatttacaaaatgggaagcttgcctgaagctgttgatgctgccaggccgaaggccactctagtggacagtgagtcagcagatgatgaactcacaaacttgaactggcttcatgaaagcactaatcttctaacaaacttcagcctcggaagtgagggtcttccaattgttagtccattgtatgacatagagggagatgatgtgccatcctttggaccagcttgctaccagaacccagaaaaaaaatcagcgacttcaaagcccccatactcctttagtcttctcatttatatggccattgagcactctccaaataaatgtttgcctgtcaaagaaatttatagctggattctggaccattttccatattttgctactgcaccaacaggctggaagaattctgttcgacataatctgtccctgaataaatgttttcagaaagtggaaagaagccatggcaaggttaatggaaaaggttccttatggtgtgttgatccggaatataaacccaatcttatccaggcactgaagaagcaacctttttcttcagcatcttcacaaaatggttctttatcacctcactatttaagctctgtaatcaagcagaaccaggtgcgaaacctcaaagaatctgatattgatgctgctgctgcaatgatgcttttaaatacttctatagaacaaggaattttagaatgtgagaagcctcttcctcttaaaacagcattgcaaaaaaagaggagttacggcaatgcatttcatcatcccagtgctgtacgattacaagagagtgattctttagccaccagcattgatccaaaagaagatcacaattacagtgcaagtagcatggcagcacagcgttgtgcatccaggtctagcgtgtcttctctgtcttctgtggatgaggtatatgaatttatcccaaagaatagtcacgtgggaagtgatggcagtgaaggatttcacagtgaagaagatacagacgttgattatgaagatgatcctcttggagacagtggctatgcatcacagccttgtgcaaaaatctctgaaaaagggcagtcaggcaaaaagatgcgaaaacagacatgtcaagaaattgatgaggagctcaaagaggcagctggatctctgctccaccttgctggaattcgtacatgtttaggttccctaataagtactgcaaagacacaaaatcaaaagcaacggaaaaaa

SEQ ID NO: 53 - protein, 490 aa, Homo sapiens
MGPVMPPSKKPESSGISVSSGLSQCYGGSGFSKALQEDDDLDFSLPDIRLEEGAMEDEELTNLNWLHESKNLLKSFGESVLRSVSPVQDLDDDTPPSPAHSDMPYDARQNPNCKPPYSFSCLIFMAIEDSPTKRLPVKDIYNWILEHFPYFANAPTGWKNSVRHNLSLNKCFKKVDKERSQSIGKGSLWCIDPEYRQNLIQALKKTPYHPHPHVFNTPPTCPQAYQSTSGPPIWPGSTFFKRNGALLQDPDIDAASAMMLLNTPPEIQAGFPPGVIQNGARVLSRGLFPGVRPLPITPIGVTAAMRNGITSCRMRTESEPSCGSPVVSGDPKEDHNYSSAKSSNARSTSPTSDSISSSSSSADDHYEFATKGSQEGSEGSEGSFRSHESPSDTEEDDRKHSQKEPKDSLGDSGYASQHKKRQHFAKARKVPSDTLPLKKRRTEKPPESDDEEMKEAAGSLLHLAGIRSCLNNITNRTAKGQKEQKETTKN

SEQ ID NO: 54 - DNA, 1470 bp, Homo sapiens
atgggtccagtcatgcctcccagtaagaagccagaaagctcaggaattagtgtctccagtggactgagtcagtgttacgggggcagcggtttctccaaggcccttcaggaagacgatgacctcgacttttctctgcctgacatccgattagaagagggggccatggaagatgaagagctgaccaacctgaactggctgcacgagagcaagaacttgctgaagagctttggggagtcggtcctcaggagtgtcagccccgtccaggacctggacgatgacacccccccatcccctgcccactctgacatgccctacgatgccaggcagaaccccaactgcaaacccccctactccttcagctgcctcatatttatggccatcgaggactctccaaccaagcgcctgccagtgaaggatatctacaactggatcttggaacattttccgtattttgcaaatgcacctactgggtggaaaaactcagtgagacacaatttatcattgaataagtgttttaagaaagtggacaaagagaggagtcagagtattgggaaagggtcgttgtggtgcatagacccagagtatagacaaaatctaattcaggctttgaaaaagacaccttatcacccacacccacacgtgttcaatacacctcccacctgtcctcaggcatatcaaagcacatcaggtccacccatctggccgggcagtaccttcttcaagagaaatggagcccttctccaagatcctgacattgatgctgccagtgccatgatgcttttgaatactccccctgagatacaagcaggttttcctccaggagtgatccaaaatggagcgcgggtcctgagccgagggctgtttcctggcgtgcggccgctgccaatcactcccattggggtgacagcggccatgaggaatggcatcaccagctgccggatgcggactgagagtgagccatcttgtggctccccagtggtcagcggagaccccaaggaggatcacaactacagcagtgccaagtcctccaacgcccggagcacctcgcccaccagcgactccatctcctcctcctcctcctcagccgacgaccactatgagtttgccaccaaggggagccaggagggcagcgagggcagcgaggggagcttccggagccacgagagccccagcgacacggaagaggacgacaggaagcacagccagaaggagcccaaggattctctgggggacagcgggtacgcatcccagcacaagaagcgccagcacttcgccaaggccaggaaggtccccagcgacacactgcccctcaaaaagagacgcaccgaaaagccccccgagagcgatgatgaggagatgaaagaagcggcagggtccctcctgcacttagcagggatccggtcctgtttgaataacatcaccaatcggacggcaaaggggcagaaagagcaaaaggaaaccacaaaaaat

SEQ ID NO: 55 - protein, 517 aa, Homo sapiens
MIESDTSSIMSGIIRNSGQNHHPSPQEYRLLATTSDDDLPGDLQSLSWLTAVDVPRLQQMASGRVDLGGPCVPHPHPGALAGVADLHVGATPSPLLHGPAGMAPRGMPGLGPITGHRDSMSQFPVGGQPSSGLQDPPHLYSPATQPQFPLPPGAQQCPPVGLYGPPFGVRPPYPQPHVAVHSSQELHPKHYPKPIYSYSCLIAMALKNSKTGSLPVSEIYSFMKEHFPYFKTAPDGWKNSVRHNLSLNKCFEKVENKMSGSSRKGCLWALNLARIDKMEEEMHKWKRKDLAAIHRSMANPEELDKLISDRPESCRRPGKPGEPEAPVLTHATTVAVAHGCLAVSQLPPQPLMTLSLQSVPLHHQVQPQAHLAPDSPAPAQTPPLHALPDLSPSPLPHPAMGRAPVDFINISTDMNTEVDALDPSIMDFALQGNLWEEMKDEGFSLDTLGAFADSPLGCDLGASGLTPASGGSDQSFPDLQVTGLYTAYSTPDSVAASGTSSSSQYLGAQGNKPIALL

SEQ ID NO: 56 - DNA, 1551 bp, Homo sapiens
atgatagaaagtgacacctcatccataatgtcaggaattattcgaaactcagggcaaaatcaccacccctctccacaggaatacaggcttctagccaccaccagcgatgatgaccttcccggggacctgcagtcgctgtcgtggctcacggcggtggatgtgcctcggctgcagcagatggcaagtggccgcgtggacctgggtggcccctgcgtgccacatccacacccaggtgccttggctggggtggccgacctgcatgtgggagccactccaagtccccttctccatggcccagcaggcatggccccccgaggcatgccaggtctgggccccataactggccacagagacagcatgagccagttccccgtggggggccagccctcatctggcctgcaggacccgccgcatctgtactcacctgccacccaaccacagttcccgctccccccgggtgcccagcagtgccctcctgtgggcctctatggccccccatttggggtgcggcccccctacccccagccccacgtggctgtgcattcatctcaagaactgcaccccaaacactaccccaagcccatctactcgtacagctgtctgatcgccatggccctgaagaacagcaagacaggcagcctgcctgtgagcgagatctacagcttcatgaaggagcacttcccctacttcaagacggcccccgacgggtggaagaactcggtgcggcacaacctgtctctgaacaagtgcttcgagaaggtggagaacaagatgagcggctcctcccgcaagggctgcctgtgggctctgaacctggcccgcatcgacaagatggaggaggagatgcacaagtggaagaggaaggacctggctgccatccaccggagtatggccaaccctgaggagttggacaagctgatctccgaccggcctgaaagctgccggcgccccggcaaaccgggggaaccagaggcccccgtgctgactcacgccaccacagtggccgtggcgcatggctgcctggctgtctcccagctcccaccccagccactgatgaccctgtccctgcagtcagtccccctgcaccaccaggtccagccccaggcacatcttgctccagactctccagcaccagcccagaccccgccactgcacgccctgccggacctcagccccagcccgctcccccaccccgccatgggaagggctcctgtagacttcatcaacatcagcaccgacatgaacactgaggtggatgccctcgacccgagcatcatggacttcgctctgcaggggaacctgtgggaggagatgaaggatgagggattcagcttggacacactgggcgcctttgcagactccccgcttggctgtgacctgggggcctcaggcctaacccctgcctcgggtggcagcgaccagtccttcccagacttgcaggtgacgggtctctacacagcgtactccactccggacagtgtggctgcatcgggcaccagctcctcctcccagtacctgggtgcacaggggaacaagcctatagccctgctt

SEQ ID NO: 57 - protein, 655 aa, Homo sapiens
MAEAPQVVEIDPDFEPLPRPRSCTWPLPRPEFSQSNSATSSPAPSGSAAANPDAAAGLPSASAAAVSADFMSNLSLLEESEDFPQAPGSVAAAVAAAAAAAATGGLCGDFQGPEAGCLHPAPPQPPPPGPLSQHPPVPPAAAGPLAGQPRKSSSSRRNAWGNLSYADLITKAIESSAEKRLTLSQIYEWMVKSVPYFKDKGDSNSSAGWKNSIRHNLSLHSKFIRVQNEGTGKSSWWMLNPEGGKSGKSPRRRAASMDNNSKFAKSRSRAAKKKASLQSGQEGAGDSPGSQFSKWPASPGSHSNDDFDNWSTFRPRTSSNASTISGRLSPIMTEQDDLGEGDVHSMVYPPSAAKMASTLPSLSEISNPENMENLLDNLNLLSSPTSLTVSTQSSPGTMMQQTPCYSFAPPNTSLNSPSPNYQKYTYGQSSMSPLPQMPIQTLQDNKSSYGGMSQYNCAPGLLKELLTSDSPPHNDIMTPVDPGVAQPNSRVLGQNVMMGPNSVMSTYGSQVSHNKMMNPSSHTHPGHAQQTSAVNGRPLPHTVSTMPHTSGMNRLTQVKTPVQVPLPHPMQMSALGGYSSVSSCNGYGRMGLLHQEKLPSDLDGMFIERLDCDMESIIRNDLMDGDTLDFNFDNVLPNQSFPHSVKTTTHSWVSG

SEQ ID NO: 58 - DNA, 1965 bp, Homo sapiens
atggccgaggcgcctcaggtggtggagatcgacccggacttcgagccgctgccccggccgcgctcgtgcacctggccgctgcccaggccggagtttagccagtccaactcggccacctccagcccggcgccgtcgggcagcgcggctgccaaccccgacgccgcggcgggcctgccctcggcctcggctgccgctgtcagcgccgacttcatgagcaacctgagcttgctggaggagagcgaggacttcccgcaggcgcccggctccgtggcggcggcggtggcggcggcggccgccgcggccgccaccggggggctgtgcggggacttccagggcccggaggcgggctgcctgcacccagcgccaccgcagcccccgccgcccgggccgctgtcgcagcacccgccggtgccccccgccgccgctgggccgctcgcggggcagccgcgcaagagcagctcgtcccgccgcaacgcgtggggcaacctgtcctacgccgacctcatcaccaaggccatcgagagctcggcggagaagcggctcacgctgtcgcagatctacgagtggatggtcaagagcgtgccctacttcaaggataagggtgacagcaacagctcggcgggctggaagaattcaattcgtcataatctgtccctacacagcaagttcattcgtgtgcagaatgaaggaactggaaaaagttcttggtggatgctcaatccagagggtggcaagagcgggaaatctcctaggagaagagctgcatccatggacaacaacagtaaatttgctaagagccgaagccgagctgccaagaagaaagcatctctccagtctggccaggagggtgctggggacagccctggatcacagttttccaaatggcctgcaagccctggctctcacagcaatgatgactttgataactggagtacatttcgccctcgaactagctcaaatgctagtactattagtgggagactctcacccattatgaccgaacaggatgatcttggagaaggggatgtgcattctatggtgtacccgccatctgccgcaaagatggcctctactttacccagtctgtctgagataagcaatcccgaaaacatggaaaatcttttggataatctcaaccttctctcatcaccaacatcattaactgtttcgacccagtcctcacctggcaccatgatgcagcagacgccgtgctactcgtttgcgccaccaaacaccagtttgaattcacccagcccaaactaccaaaaatatacatatggccaatccagcatgagccctttgccccagatgcctatacaaacacttcaggacaataagtcgagttatggaggtatgagtcagtataactgtgcgcctggactcttgaaggagttgctgacttctgactctcctccccataatgacattatgacaccagttgatcctggggtagcccagcccaacagccgggttctgggccagaacgtcatgatgggccctaattcggtcatgtcaacctatggcagccaggtatctcataacaaaatgatgaatcccagctcccatacccaccctggacatgctcagcagacatctgcagttaacgggcgtcccctgccccacacggtaagcaccatgccccacacctcgggtatgaaccgcctgacccaagtgaagacacctgtacaagtgcctctgccccaccccatgcagatgagtgccctggggggctactcctccgtgagcagctgcaatggctatggcagaatgggccttctccaccaggagaagctcccaagtgacttggatggcatgttcattgagcgcttagactgtgacatggaatccatcattcggaatgacctcatggatggagatacattggattttaactttgacaatgtgttgcccaaccaaagcttcccacacagtgtcaagacaacgacacatagctgggtgtcaggc

SEQ ID NO: 59 - protein, 673 aa, Homo sapiens
MAEAPASPAPLSPLEVELDPEFEPQSRPRSCTWPLQRPELQASPAKPSGETAADSMIPEEEDDEDDEDGGGRAGSAMAIGGGGGSGTLGSGLLLEDSARVLAPGGQDPGSGPATAAGGLSGGTQALLQPQQPLPPPQPGAAGGSGQPRKCSSRRNAWGNLSYADLITRAIESSPDKRLTLSQIYEWMVRCVPYFKDKGDSNSSAGWKNSIRHNLSLHSRFMRVQNEGTGKSSWWIINPDGGKSGKAPRRRAVSMDNSNKYTKSRGRAAKKKAALQTAPESADDSPSQLSKWPGSPTSRSSDELDAWTDFRSRTNSNASTVSGRLSPIMASTELDEVQDDDAPLSPMLYSSSASLSPSVSKPCTVELPRLTDMAGTMNLNDGLTENLMDDLLDNITLPPSQPSPTGGLMQRSSSFPYTTKGSGLGSPTSSFNSTVFGPSSLNSLRQSPMQTIQENKPATFSSMSHYGNQTLQDLLTSDSLSHSDVMMTQSDPLMSQASTAVSAQNSRRNVMLRNDPMMSFAAQPNQGSLVNQNLLHHQHQTQGALGGSRALSNSVSNMGLSESSSLGSAKHQQQSPVSQSMQTLSDSLSGSSLYSTSANLPVMGHEKFPSDLDLDMFNGSLECDMESIIRSELMDADGLDFNFDSLISTQNVVGLNVGNFTGAKQASSQSWVPG

SEQ ID NO: 60 - DNA, 2019 bp, Homo sapiens
atggcagaggcaccggcttccccggccccgctctctccgctcgaagtggagctggacccggagttcgagccccagagccgtccgcgatcctgtacgtggcccctgcaaaggccggagctccaagcgagccctgccaagccctcgggggagacggccgctgactccatgatccccgaggaggaggacgatgaagacgacgaggacggcgggggacgggccggctcggccatggcgatcggcggcggcggcgggagcggcacgctgggctccgggctgctccttgaggactcggcccgggtgctggcacccggagggcaagaccccgggtctgggccagccaccgcggcgggcgggctgagcgggggtacacaggcgctgctgcagcctcagcaaccgctgccaccgccgcagccgggggcggctgggggctccgggcagccgaggaaatgttcgtcgcggcggaacgcctggggaaacctgtcctacgcggacctgatcacccgcgccatcgagagctccccggacaaacggctcactctgtcccagatctacgagtggatggtgcgttgcgtgccctacttcaaggataagggcgacagcaacagctctgccggctggaagaactccatccggcacaacctgtcactgcatagtcgattcatgcgggtccagaatgagggaactggcaagagctcttggtggatcatcaaccctgatggggggaagagcggaaaagccccccggcggcgggctgtctccatggacaatagcaacaagtataccaagagccgtggccgcgcagccaagaagaaggcagccctgcagacagcccccgaatcagctgacgacagtccctcccagctctccaagtggcctggcagccccacgtcacgcagcagtgatgagctggatgcgtggacggacttccgttcacgcaccaattctaacgccagcacagtcagtggccgcctgtcgcccatcatggcaagcacagagttggatgaagtccaggacgatgatgcgcctctctcgcccatgctctacagcagctcagccagcctgtcaccttcagtaagcaagccgtgcacggtggaactgccacggctgactgatatggcaggcaccatgaatctgaatgatgggctgactgaaaacctcatggacgacctgctggataacatcacgctcccgccatcccagccatcgcccactgggggactcatgcagcggagctctagcttcccgtataccaccaagggctcgggcctgggctccccaaccagctcctttaacagcacggtgttcggaccttcatctctgaactccctacgccagtctcccatgcagaccatccaagagaacaagccagctaccttctcttccatgtcacactatggtaaccagacactccaggacctgctcacttcggactcacttagccacagcgatgtcatgatgacacagtcggaccccttgatgtctcaggccagcaccgctgtgtctgcccagaattcccgccggaacgtgatgcttcgcaatgatccgatgatgtcctttgctgcccagcctaaccagggaagtttggtcaatcagaacttgctccaccaccagcaccaaacccagggcgctcttggtggcagccgtgccttgtcgaattctgtcagcaacatgggcttgagtgagtccagcagccttgggtcagccaaacaccagcagcagtctcctgtcagccagtctatgcaaaccctctcggactctctctcaggctcctccttgtactcaactagtgcaaacctgcccgtcatgggccatgagaagttccccagcgacttggacctggacatgttcaatgggagcttggaatgtgacatggagtccattatccgtagtgaactcatggatgctgatgggttggattttaactttgattccctcatctccacacagaatgttgttggtttgaacgtggggaacttcactggtgctaagcaggcctcatctcagagctgggtgccaggc

SEQ ID NO: 61 - protein, 505 aa, Homo sapiens
MDPGNENSATEAAAIIDLDPDFEPQSRPRSCTWPLPRPEIANQPSEPPEVEPDLGEKVHTEGRSEPILLPSRLPEPAGGPQPGILGAVTGPRKGGSRRNAWGNQSYAELISQAIESAPEKRLTLAQIYEWMVRTVPYFKDKGDSNSSAGWKNSIRHNLSLHSKFIKVHNEATGKSSWWMLNPEGGKSGKAPRRRAASMDSSSKLLRGRSKAPKKKPSVLPAPPEGATPTSPVGHFAKWSGSPCSRNREEADMWTTFRPRSSSNASSVSTRLSPLRPESEVLAEEIPASVSSYAGGVPPTLNEGLELLDGLNLTSSHSLLSRSGLSGFSLQHPGVTGPLHTYSSSLFSPAEGPLSAGEGCFSSSQALEALLTSDTPPPPADVLMTQVDPILSQAPTLLLLGGLPSSSKLATGVGLCPKPLEAPGPSSLVPTLSMIAPPPVMASAPIPKALGTPVLTPPTEAASQDRMPQDLDLDMYMENLECDMDNIISDLMDEGEGLDFNFEPDP

SEQ ID NO: 62 - DNA, 1515 bp, Homo sapiens
atggatccggggaatgagaattcagccacagaggctgccgcgatcatagacctagatcccgacttcgaaccccagagccgtccccgctcctgcacctggccccttccccgaccagagatcgctaaccagccgtccgagccgcccgaggtggagccagatctgggggaaaaggtacacacggaggggcgctcagagccgatcctgttgccctctcggctcccagagccggccgggggcccccagcccggaatcctgggggctgtaacaggtcctcggaagggaggctcccgccggaatgcctggggaaatcagtcatatgcagaactcatcagccaggccattgaaagcgccccggagaagcgactgacacttgcccagatctacgagtggatggtccgtactgtaccctacttcaaggacaagggtgacagcaacagctcagcaggatggaagaactcgatccgccacaacctgtccctgcacagcaagttcatcaaggttcacaacgaggccaccggcaaaagctcttggtggatgctgaaccctgagggaggcaagagcggcaaagccccccgccgccgggccgcctccatggatagcagcagcaagctgctccggggccgcagtaaagcccccaagaagaaaccatctgtgctgccagctccacccgaaggtgccactccaacgagccctgtcggccactttgccaagtggtcaggcagcccttgctctcgaaaccgtgaagaagccgatatgtggaccaccttccgtccacgaagcagttcaaatgccagcagtgtcagcacccggctgtcccccttgaggccagagtctgaggtgctggcggaggaaataccagcttcagtcagcagttatgcagggggtgtccctcccaccctcaatgaaggtctagagctgttagatgggctcaatctcacctcttcccattccctgctatctcggagtggtctctctggcttctctttgcagcatcctggggttaccggccccttacacacctacagcagctcccttttcagcccagcagaggggcccctgtcagcaggagaagggtgcttctccagctcccaggctctggaggccctgctcacctctgatacgccaccaccccctgctgacgtcctcatgacccaggtagatcccattctgtcccaggctccgactcttctgttgctgggggggcttccttcctccagtaagctggccacgggcgtcggcctgtgtcccaagcccctagaggctccaggccccagcagtctggttcccaccctttctatgatagcaccacctccagtcatggcaagtgcccccatccccaaggctctggggactcctgtgctcacaccccctactgaagctgcaagccaagacagaatgcctcaggatctagatcttgatatgtatatggagaacctggagtgtgacatggataacatcatcagtgacctcatggatgagggcgagggactggacttcaactttgagccagatccc

SEQ ID NO: 63 - protein, 492 aa, Homo sapiens
MAAKLRAHQVDVDPDFAPQSRPRSCTWPLPQPDLAGDEDGALGAGVAEGAEDCGPERRATAPAMAPAPPLGAEVGPLRKAKSSRRNAWGNLSYADLITKAIESAPDKRLTLSQIYDWMVRYVPYFKDKGDSNSSAGWKNSIRHNLSLHTRFIRVQNEGTGKSSWWMLNPEGGKTGKTPRRRAVSMDNGAKFLRIKGKASKKKQLQAPERSPDDSSPSAPAPGPVPAAAKWAASPASHASDDYEAWADFRGGGRPLLGEAAELEDDEALEALAPSSPLMYPSPASALSPALGSRCPGELPRLAELGGPLGLHGGGGAGLPEGLLDGAQDAYGPRAAPRPGPVLGAPGELALAGAAAAYPGKGAAPYAPPAPSRSALAHPISLMTLPGEAGAAGLAPPGHAAAFGGPPGGLLLDALPGPYAAAAAGPLGAAPDRFPADLDLDMFSGSLECDVESIILNDFMDSDEMDFNFDSALPPPPPGLAGAPPPNQSWVPG

SEQ ID NO: 64 - DNA, 1476 bp, Homo sapiens
atggctgcgaagctgcgagcgcatcaggtggacgtggacccggacttcgcgccgcagagccggccgcgctcgtgtacctggcccctgccgcagcctgacttggccggcgacgaggacggagcgctgggcgcaggggtggccgagggcgccgaggactgcgggccggagcgccgggctacggccccggcgatggccccagcgccgcccctgggcgcggaggtcggaccgctgcggaaagcgaagagctctcggcggaacgcgtgggggaacctgtcctacgccgacctcatcaccaaagccatcgagagcgccccggacaagcggctcacgctctcgcagatctacgactggatggtccgttacgtgccctacttcaaggataaaggcgacagcaacagctcggccggctggaagaactccatccggcacaacctgtcgctgcacacccgtttcatccgcgtgcagaacgagggcaccggcaagagttcgtggtggatgctgaaccccgagggcggaaagacagggaagaccccgcggcgcagggccgtgtccatggacaacggggccaagttcctgcgcatcaagggcaaggcgagcaagaagaagcagctgcaggcgcccgagcgaagcccggacgacagctccccgagtgcgcccgccccggggccggtgcctgccgcagccaagtgggccgccagccccgcctcgcacgccagcgacgactacgaggcttgggccgacttccgcggcggcgggagacccctgctcggggaggcggccgagctggaggacgacgaggccctggaggccctggcgccatcatcgccgctcatgtacccaagccccgccagcgcgctgtcgccggcgctgggctcgcgctgtccgggtgagctgccccgcctggccgagctgggaggcccgctgggcctgcacggcggcggcggcgcggggctgcccgagggcctgctggacggcgcgcaggacgcgtacgggccgcgggccgcgcccaggcccggcccggtgctgggtgcgccgggggagctggcgctggcgggcgcagccgccgcctaccccggcaaaggggcggccccgtacgcgccgcccgcgccctcgcgcagtgccttagcccaccccatcagccttatgacgctgcccggcgaggcgggcgccgcgggcctggcaccgccgggccacgccgccgccttcgggggcccgcccggcggcctcctgctggacgctctgccggggccctacgctgccgccgccgccgggccgctgggcgccgcgcccgaccgcttcccggccgacctggacctcgacatgttcagcgggagcctcgagtgcgacgtggagtccatcatcctcaacgacttcatggacagcgacgaaatggacttcaacttcgattcggccctgcctccgccgccgccgggcctggccggggccccgccccccaaccagagctgggtgccgggc

SEQ ID NO: 65 - protein, 677 aa, Homo sapiens
MMQESGTETKSNGSAIQNGSGGSNHLLECGGLREGRSNGETPAVDIGAADLAHAQQQQQQALQVARQLLLQQQQQQQVSGLKSPKRNDKQPALQVPVSVAMMTPQVITPQQMQQILQQQVLSPQQLQVLLQQQQALMLQQQQLQEFYKKQQEQLQLQLLQQQHAGKQPKEQQQVATQQLAFQQQLLQMQQLQQQHLLSLQRQGLLTIQPGQPALPLQPLAQGMIPTELQQLWKEVTSAHTAEETTGNNHSSLDLTTTCVSSSAPSKTSLIMNPHASTNGQLSVHTPKRESLSHEEHPHSHPLYGHGVCKWPGCEAVCEDFQSFLKHLNSEHALDDRSTAQCRVQMQVVQQLELQLAKDKERLQAMMTHLHVKSTEPKAAPQPLNLVSSVTLSKSASEASPQSLPHTPTTPTAPLTPVTQGPSVITTTSMHTVGPIRRRYSDKYNVPISSADIAQNQEFYKNAEVRPPFTYASLIRQAILESPEKQLTLNEIYNWFTRMFAYFRRNAATWKNAVRHNLSLHKCFVRVENVKGAVWTVDEVEFQKRRPQKISGNPSLIKNMQSSHAYCTPLSAALQASMAENSIPLYTTASMGNPTLGNLASAIREELNGAMEHTNSNESDSSPGRSPMQAVHPVHVKEEPLDPEEAEGPLSLVTTANHSPDFDHDRDYEDEPVNEDME

SEQ ID NO: 66 - DNA, 2031 bp, Homo sapiens
atgatgcaagaatctgggactgagacaaaaagtaacggttcagccatccagaatgggtcgggcggcagcaaccacttactagagtgcggcggtcttcgggaggggcggtccaacggagagacgccggccgtggacatcggggcagctgacctcgcccacgcccagcagcagcagcaacaggcacttcaggtggcaagacagctccttcttcagcagcaacagcagcagcaagttagtggattaaaatctcccaagaggaatgacaaacaaccagctcttcaggttcccgtgtcagtggctatgatgacacctcaagttatcactccccagcaaatgcagcagatcctccagcaacaagtgctgagccctcagcagctccaggttctcctccagcagcagcaggccctcatgcttcaacagcagcagcttcaagagttttataaaaaacaacaggaacagttgcagcttcaacttttacaacaacaacatgctggaaaacagcctaaagagcaacagcaggtggctacccagcagttggcttttcagcagcagcttttacagatgcagcagttacagcagcagcacctcctgtctttgcagcgccaaggccttctgacaattcagcccgggcagcctgcccttccccttcaacctcttgctcaaggcatgattccaacagaactgcagcagctctggaaagaagtgacaagtgctcatactgcagaagaaaccacaggcaacaatcacagcagtttggatctgaccacgacatgtgtctcctcctctgcaccttccaagacctccttaataatgaacccacatgcctctaccaatggacagctctcagtccacactcccaaaagggaaagtttgtcccatgaggagcacccccatagccatcctctctatggacatggtgtatgcaagtggccaggctgtgaagcagtgtgcgaagatttccaatcatttctaaaacatctcaacagtgagcatgcgctggacgatagaagtacagcccaatgtagagtacaaatgcaggttgtacagcagttagagctacagcttgcaaaagacaaagaacgcctgcaagccatgatgacccacctgcatgtgaagtctacagaacccaaagccgcccctcagcccttgaatctggtatcaagtgtcactctctccaagtccgcatcggaggcttctccacagagcttacctcatactccaacgaccccaaccgcccccctgactcccgtcacccaaggcccctctgtcatcacaaccaccagcatgcacacggtgggacccatccgcaggcggtactcagacaaatacaacgtgcccatttcgtcagcagatattgcgcagaaccaagaattttataagaacgcagaagttagaccaccatttacatatgcatctttaattaggcaggccattctcgaatctccagaaaagcagctaacactaaatgagatctataactggttcacacgaatgtttgcttacttccgacgcaacgcggccacgtggaagaatgcagtgcgtcataatcttagtcttcacaagtgttttgtgcgagtagaaaacgttaaaggggcagtatggacagtggatgaagtagaattccaaaaacgaaggccacaaaagatcagtggtaacccttcccttattaaaaacatgcagagcagccacgcctactgcacacctctcagtgcagctttacaggcttcaatggctgagaatagtatacctctatacactaccgcttccatgggaaatcccactctgggcaacttagccagcgcaatacgggaagagctgaacggggcaatggagcataccaacagcaacgagagtgacagcagtccaggcagatctcctatgcaagccgtgcatcctgtacacgtcaaagaagagcccctcgatccagaggaagctgaagggcccctgtccttagtgacaacagccaaccacagtccagattttgaccatgacagagattacgaagatgaaccagtaaacgaggacatggag

SEQ ID NO: 67 - protein, 715 aa, Homo sapiens
MMQESATETISNSSMNQNGMSTLSSQLDAGSRDGRSSGDTSSEVSTVELLHLQQQQALQAARQLLLQQQTSGLKSPKSSDKQRPLQVPVSVAMMTPQVITPQQMQQILQQQVLSPQQLQALLQQQQAVMLQQQQLQEFYKKQQEQLHLQLLQQQQQQQQQQQQQQQQQQQQQQQQQQQQQQQQQQQQQQQQHPGKQAKEQQQQQQQQQQLAAQQLVFQQQLLQMQQLQQQQHLLSLQRQGLISIPPGQAALPVQSLPQAGLSPAEIQQLWKEVTGVHSMEDNGIKHGGLDLTTNNSSSTTSSNTSKASPPITHHSIVNGQSSVLSARRDSSSHEETGASHTLYGHGVCKWPGCESICEDFGQFLKHLNNEHALDDRSTAQCRVQMQVVQQLEIQLSKERERLQAMMTHLHMRPSEPKPSPKPLNLVSSVTMSKNMLETSPQSLPQTPTTPTAPVTPITQGPSVITPASVPNVGAIRRRHSDKYNIPMSSEIAPNYEFYKNADVRPPFTYATLIRQAIMESSDRQLTLNEIYSWFTRTFAYFRRNAATWKNAVRHNLSLHKCFVRVENVKGAVWTVDEVEYQKRRSQKITGSPTLVKNIPTSLGYGAALNASLQAALAESSLPLLSNPGLINNASSGLLQAVHEDLNGSLDHIDSNGNSSPGCSPQPHIHSIHVKEEPVIAEDEDCPMSLVTTANHSPELEDDREIEEEPLSEDLE

SEQ ID NO: 68 - DNA, 2145 bp, Homo sapiens
atgatgcaggaatctgcgacagagacaataagcaacagttcaatgaatcaaaatggaatgagcactctaagcagccaattagatgctggcagcagagatggaagatcaagtggtgacaccagctctgaagtaagcacagtagaactgctgcatctgcaacaacagcaggctctccaggcagcaagacaacttcttttacagcagcaaacaagtggattgaaatctcctaagagcagtgataaacagagaccactgcaggtgcctgtgtcagtggccatgatgactccccaggtgatcacccctcagcaaatgcagcagatccttcagcaacaagtcctgtctcctcagcagctacaagcccttctccaacaacagcaggctgtcatgctgcagcagcaacaactacaagagttttacaagaaacagcaagagcagttacatcttcagcttttgcagcagcagcagcaacagcagcagcagcaacaacagcagcaacaacagcagcagcaacaacaacaacaacagcagcaacaacagcagcagcagcagcaacagcagcagcagcagcaacagcatcctggaaagcaagcgaaagagcagcagcagcagcagcagcagcaacagcaattggcagcccagcagcttgtcttccagcagcagcttctccagatgcaacaactccagcagcagcagcatctgctcagccttcagcgtcagggactcatctccattccacctggccaggcagcacttcctgtccaatcgctgcctcaagctggcttaagtcctgctgagattcagcagttatggaaagaagtgactggagttcacagtatggaagacaatggcattaaacatggagggctagacctcactactaacaattcctcctcgactacctcctccaacacttccaaagcatcaccaccaataactcatcattccatagtgaatggacagtcttcagttctaagtgcaagacgagacagctcgtcacatgaggagactggggcctctcacactctctatggccatggagtttgcaaatggccaggctgtgaaagcatttgtgaagattttggacagtttttaaagcaccttaacaatgaacacgcattggatgaccgaagcactgctcagtgtcgagtgcaaatgcaggtggtgcaacagttagaaatacagctttctaaagaacgcgaacgtcttcaagcaatgatgacccacttgcacatgcgaccctcagagcccaaaccatctcccaaacctctaaatctggtgtctagtgtcaccatgtcgaagaatatgttggagacatccccacagagcttacctcaaacccctaccacaccaacggccccagtcaccccgattacccagggaccctcagtaatcaccccagccagtgtgcccaatgtgggagccatacgaaggcgacattcagacaaatacaacattcccatgtcatcagaaattgccccaaactatgaattttataaaaatgcagatgtcagacctccatttacttatgcaactctcataaggcaggctatcatggagtcatctgacaggcagttaacacttaatgaaatttacagctggtttacacggacatttgcttacttcaggcgtaatgcagcaacttggaagaatgcagtacgtcataatcttagcctgcacaagtgttttgttcgagtagaaaatgttaaaggagcagtatggactgtggatgaagtagaataccagaagcgaaggtcacaaaagataacaggaagtccaaccttagtaaaaaatatacctaccagtttaggctatggagcagctcttaatgccagtttgcaggctgccttggcagagagcagtttacctttgctaagtaatcctggactgataaataatgcatccagtggcctactgcaggccgtccacgaagacctcaatggttctctggatcacattgacagcaatggaaacagtagtccgggctgctcacctcagccgcacatacattcaatccacgtcaaggaagagccagtgattgcagaggatgaagactgcccaatgtccttagtgacaacagctaatcacagtccagaattagaagacgacagagagattgaagaagagcctttatctgaagatctggaa

SEQ ID NO: 69 - protein, 431 aa, Homo sapiens
MPNPRPGKPSAPSLALGPSPGASPSWRAAPKASDLLGARGPGGTFQGRDLRGGAHASSSSLNPMPPSQLQLPTLPLVMVAPSGARLGPLPHLQALLQDRPHFMHQLSTVDAHARTPVLQVHPLESPAMISLTPPTTATGVFSLKARPGLPPGINVASLEWVSREPALLCTFPNPSAPRKDSTLSAVPQSSYPLLANGVCKWPGCEKVFEEPEDFLKHCQADHLLDEKGRAQCLLQREMVQSLEQQLVLEKEKLSAMQAHLAGKMALTKASSVASSDKGSCCIVAAGSQGPVVPAWSGPREAPDSLFAVRRHLWGSHGNSTFPEFLHNMDYFKFHNMRPPFTYATLIRWAILEAPEKQRTLNEIYHWFTRMFAFFRNHPATWKNAIRHNLSLHKCFVRVESEKGAVWTVDELEFRKKRSQRPSRCSNPTPGP

SEQ ID NO: 70 - DNA, 1293 bp, Homo sapiens
atgcccaaccccaggcctggcaagccctcggccccttccttggcccttggcccatccccaggagcctcgcccagctggagggctgcacccaaagcctcagacctgctgggggcccggggcccagggggaaccttccagggccgagatcttcgaggcggggcccatgcctcctcttcttccttgaaccccatgccaccatcgcagctgcagctgcccacactgcccctagtcatggtggcaccctccggggcacggctgggccccttgccccacttacaggcactcctccaggacaggccacatttcatgcaccagctctcaacggtggatgcccacgcccggacccctgtgctgcaggtgcaccccctggagagcccagccatgatcagcctcacaccacccaccaccgccactggggtcttctccctcaaggcccggcctggcctcccacctgggatcaacgtggccagcctggaatgggtgtccagggagccggcactgctctgcaccttcccaaatcccagtgcacccaggaaggacagcaccctttcggctgtgccccagagctcctacccactgctggcaaatggtgtctgcaagtggcccggatgtgagaaggtcttcgaagagccagaggacttcctcaagcactgccaggcggaccatcttctggatgagaagggcagggcacaatgtctcctccagagagagatggtacagtctctggagcagcagctggtgctggagaaggagaagctgagtgccatgcaggcccacctggctgggaaaatggcactgaccaaggcttcatctgtggcatcatccgacaagggctcctgctgcatcgtagctgctggcagccaaggccctgtcgtcccagcctggtctggcccccgggaggcccctgacagcctgtttgctgtccggaggcacctgtggggtagccatggaaacagcacattcccagagttcctccacaacatggactacttcaagttccacaacatgcgaccccctttcacctacgccacgctcatccgctgggccatcctggaggctccagagaagcagcggacactcaatgagatctaccactggttcacacgcatgtttgccttcttcagaaaccatcctgccacctggaagaacgccatccgccacaacctgagtctgcacaagtgctttgtgcgggtggagagcgagaagggggctgtgtggaccgtggatgagctggagttccgcaagaaacggagccagaggcccagcaggtgttccaaccctacacctggcccc

SEQ ID NO: 71 - protein, 678 aa, Homo sapiens
MMVESASETIRSAPSGQNGVGSLSGQADGSSGGATGTTASGTGREVTTGADSNGEMSPAELLHFQQQQALQVARQFLLQQASGLSSPGNNDSKQSASAVQVPVSVAMMSPQMLTPQQMQQILSPPQLQALLQQQQALMLQQEYYKKQQEQLHLQLLTQQQAGKPQPKEALGNKQLAFQQQLLQMQQLQQQHLLNLQRQGLVSLQPNQASGPLQTLPQAAVCPTDLPQLWKGEGAPGQPAEDSVKQEGLDLTGTAATATSFAAPPKVSPPLSHHTLPNGQPTVLTSRRDSSSHEETPGSHPLYGHGECKWPGCETLCEDLGQFIKHLNTEHALDDRSTAQCRVQMQVVQQLEIQLAKESERLQAMMAHLHMRPSEPKPFSQPLNPVPGSSSFSKVTVSAADSFPDGLVHPPTSAAAPVTPLRPPGLGSASLHGGGPARRRSSDKFCSPISSELAQNHEFYKNADVRPPFTYASLIRQAILETPDRQLTLNEIYNWFTRMFAYFRRNTATWKNAVRHNLSLHKCFVRVENVKGAVWTVDEREYQKRRPPKMTGSPTLVKNMISGLSYGALNASYQAALAESSFPLLNSPGMLNPGSASSLLPLSHDDVGAPVEPLPSNGSSSPPRLSPPQYSHQVQVKEEPAEAEEDRQPGPPLGAPNPSASGPPEDRDLEEELPGEELS

SEQ ID NO: 72 - DNA, 2034 bp, Homo sapiens
atgatggtggaatctgcctcggagacaatcaggtcggctccatctggtcagaatggcgtgggcagcctctctgggcaagcagatggcagcagcggcggggccacagggacaactgcaagtggcacgggcagggaagtgaccacgggtgcagacagcaatggtgagatgagtcccgcagagctgctgcacttccagcagcaacaggctctccaagtggcccggcagttcctgctgcagcaggcctcaggcctgagctccccagggaacaatgacagcaaacagtctgcctctgctgtgcaggtgcctgtgtcggtggccatgatgtcgccgcagatgcttaccccgcaacagatgcagcagatcctgtcgcccccgcagctgcaggccttgctccagcagcagcaagccctcatgctccagcaggagtactacaagaagcagcaggagcagctccacctgcagctcctcacccagcagcaggctgggaaaccgcagcccaaagaggcactggggaacaagcagctggccttccagcagcagctcctgcaaatgcaacagttgcagcagcagcacctgctcaacctgcagaggcaggggctggtcagcctgcagcccaaccaagcctcggggcccctccagacccttccgcaagcagctgtttgcccaacagacctgccccagctgtggaagggcgagggtgcccccgggcagcctgccgaggacagcgtcaagcaggaggggctggacctcactggcacggccgccaccgctacctcgtttgccgctccccccaaggtctcaccccccctctcccaccataccctgcccaacggacagcctactgtgctcacatctcggagagacagctcttcccacgaggagacccccggctcccaccccctgtacggacacggagagtgcaagtggccaggctgtgagaccctgtgtgaagacctgggccagtttatcaaacacctcaacacagagcacgccctggatgaccggagtacagcccagtgccgggtacagatgcaggtggtgcagcagctggagatccagctcgccaaggagagcgagcggctgcaggccatgatggcccacctgcacatgcggccctcggagcccaagcccttcagccagccactgaacccggtccccggctcctcctcattctccaaggtgaccgtctctgcagcagactcattcccagatggtctcgtgcaccccccgacctcggccgcagcccctgtcacccctctacggccccctggcctgggctctgcctccctgcatggtgggggcccagcccgtcggagaagcagtgacaagttctgctcccccatctcctcagagctggcccagaatcatgagttctacaagaacgccgacgtccggccccccttcacctacgcctccctcatccgccaggccatcctggaaacccctgacaggcagctgaccctgaatgagatctataactggttcaccaggatgttcgcctatttccgcagaaacactgccacctggaagaacgccgtgcgccacaacctcagcctgcacaagtgcttcgtccgcgtggagaacgtcaagggtgccgtgtggactgtggacgagcgggagtatcagaagcggagaccgccaaagatgacagggagccccaccctggtgaagaacatgatctctggcctcagctatggagcacttaatgccagctaccaggccgccctggccgagagcagcttccccctcctcaacagccctggcatgctgaaccctggctccgccagcagcctgctgcccctcagccacgatgacgtgggtgcccccgtggagccgctgcccagcaacggcagcagcagccctcctcgcctctccccgccccagtacagccaccaggtgcaggtgaaggaggagccagcagaggcagaggaagacaggcagcccgggcctcccctgggcgcccctaaccccagcgcctcggggcctccggaagacagggacctggaggaggagctgccgggagaagaactgtcc

SEQ ID NO: 73 - protein, 403 aa, Homo sapiens
MKLEVFVPRAAHGDKQGSDLEGAGGSDAPSPLSAAGDDSLGSDGDCAANSPAAGGGARDPPGDGEQSAGGGPGAEEAIPAAAAAAVVAEGAEAGAAGPGAGGAGSGEGARSKPYTRRPKPPYSYIALIAMAIRDSAGGRLTLAEINEYLMGKFPFFRGSYTGWRNSVRHNLSLNDCFVKVLRDPSRPWGKDNYWMLNPNSEYTFADGVFRRRRKRLSHRAPVPAPGLRPEEAPGLPAAPPPAPAAPASPRMRSPARQEERASPAGKFSSSFAIDSILRKPFRSRRLRDTAPGTTLQWGAAPCPPLPAFPALLPAAPCRALLPLCAYGAGEPARLGAREAEVPPTAPPLLLAPLPAAAPAKPLRGPAAGGAHLYCPLRLPAALQAASVRRPGPHLPYPVETLLA

SEQ ID NO: 74 - DNA, 1209 bp, Homo sapiens
atgaagttggaggtgttcgtccctcgcgcggcccacggggacaagcagggcagtgacctggagggcgcgggcggcagcgacgcgccgtccccgctgtcggcggcgggagacgactccctgggctcagatggggactgcgcggccaacagcccggccgcgggcggcggcgccagagatccgccgggcgacggcgaacagagtgcgggaggcgggccgggcgcggaggaggcgatcccggcagcagctgctgcagcggtggtggcggagggcgcggaggccggggcggcggggccaggcgcgggcggcgcggggagcggcgagggtgcacgcagcaagccatatacgcggcggcccaagcccccctactcgtacatcgcgctcatcgccatggccatccgcgactcggcgggcgggcgcttgacgctggcggagatcaacgagtacctcatgggcaagttcccctttttccgcggcagctacacgggctggcgcaactccgtgcgccacaacctttcgctcaacgactgcttcgtcaaggtgctgcgcgacccctcgcggccctggggcaaggacaactactggatgctcaaccccaacagcgagtacaccttcgccgacggggtcttccgccgccgccgcaagcgcctcagccaccgcgcgccggtccccgcgcccgggctgcggcccgaggaggccccgggcctccccgccgccccgccgcccgcgcccgccgccccggcctcgccccgcatgcgctcgcccgcccgccaggaggagcgcgccagccccgcgggcaagttctccagctccttcgccatcgacagcatcctgcgcaagcccttccgcagccgccgcctcagggacacggcccccgggacgacgcttcagtggggcgccgcgccctgcccgccgctgcccgcgttccccgcgctcctccccgcggcgccctgcagggccctgctgccgctctgcgcgtacggcgcgggcgagccggcgcggctgggcgcgcgcgaggccgaggtgccaccgaccgcgccgcccctcctgcttgcacctctcccggcggcggcccccgccaagccactccgaggcccggcggccggcggcgcgcacctgtactgccccctgcggctgcccgcagccctgcaggcggcctcagtccgccgccctggcccgcacctgccgtacccggtggagacgctcctagcc

SEQ ID NO: 75 - protein, 292 aa, Homo sapiens
MGNELFLAFTTSHLPLAEQKLARYKLRIVKPPKLPLEKKPNPDKDGPDYEPNLWMWVNPNIVYPPGKLEVSGRRKREDLTSTLPSSQPPQKEEDASCSEAAGVESLSQSSSKRSPPRKRFAFSPSTWELTEEEEAEDQEDSSSMALPSPHKRAPLQSRRLRQASSQAGRLWSRPPLNYFHLIALALRNSSPCGLNVQQIYSFTRKHFPFFRTAPEGWKNTVRHNLCFRDSFEKVPVSMQGGASTRPRSCLWKLTEEGHRRFAEEARALASTRLESIQQCMSQPDVMPFLFDL

SEQ ID NO: 76 - DNA, 876 bp, Homo sapiens
atggggaacgagctctttctggccttcaccacatctcacctccccttagcggagcagaaacttgccaggtataaactccgaattgttaagccaccaaaattacccctagagaaaaaacccaaccctgataaggatggtccagattatgagcccaacctctggatgtgggtaaatcccaacattgtgtatccccctggaaagctggaggtctcaggacgtaggaagagggaggacctgacaagcacactcccctcctctcagccaccccagaaggaggaagatgccagctgctcagaggccgcaggggtggaatcactgtcccagtcctccagcaagcggtctccccctcggaagcggtttgccttttcccccagcacctgggagctcacagaagaggaggaggctgaggaccaggaagacagctcctctatggctctcccatcccctcacaaaagggcccccctccagagtcggaggcttcggcaagccagcagccaggcggggaggctctggtcccggccccctctcaattacttccacctaattgccctggcattaagaaacagttccccctgtggcctcaacgtgcaacagatctacagtttcactcgaaagcacttcccctttttccggacggccccggaaggctggaagaatactgtccgtcacaatctctgttttcgagacagctttgagaaagtgcctgtcagcatgcagggcggggccagcacacggcctcgatcttgcctctggaagttgaccgaggagggacaccgccgctttgcggaggaggcccgcgccttggcttccactcggctagaaagtatccaacagtgcatgagccagccagatgtgatgcccttcctctttgatctt

SEQ ID NO: 77 - protein, 311 aa, Homo sapiens
MDLKLKDCEFWYSLHGQVPGLLDWDMRNELFLPCTTDQCSLAEQILAKYRVGVMKPPEMPQKRRPSPDGDGPPCEPNLWMWVDPNILCPLGSQEAPKPSGKEDLTNISPFPQPPQKDEGSNCSEDKVVESLPSSSSEQSPLQKQGIHSPSDFELTEEEAEEPDDNSLQSPEMKCYQSQKLWQINNQEKSWQRPPLNCSHLIALALRNNPHCGLSVQEIYNFTRQHFPFFWTAPDGWKSTIHYNLCFLDSFEKVPDSLKDEDNARPRSCLWKLTKEGHRRFWEETRVLAFAQRERIQECMSQPELLTSLFDL

SEQ ID NO: 78 - DNA, 933 bp, Homo sapiens
atggacttaaaactaaaagactgtgaattttggtatagtctccatggccaggtcccagggctgctggactgggacatgaggaatgagttatttctgccttgtaccacagaccagtgctctttagctgagcaaatccttgccaaatacagagtcggagtaatgaagcccccagaaatgcctcagaagaggagacccagtcctgatggagatggtcctccctgtgaacccaatctgtggatgtgggtggaccccaatatcctgtgcccccttggcagccaggaggccccaaagcccagtggaaaagaggatctgacaaacatttctcctttccctcagcccccacaaaaagacgaagggtctaactgctcagaggacaaagtggtagagtctctgccatcttcctccagtgagcagtctcctttacagaagcagggtatccattcccccagtgactttgagctcacagaagaggaggctgaggaaccagacgacaactccctccagtcccctgaaatgaaatgttaccagagccagaaactatggcaaatcaacaaccaagagaagtcctggcaaaggccccctctcaattgtagccaccttattgccctagcattaagaaacaacccccactgtggcctcagtgtgcaggagatctacaatttcacccgacagcatttcccctttttctggacagctccggatggctggaagagcaccattcattacaacctctgcttcctggacagctttgagaaggtgccagacagccttaaggatgaagataatgcaagacctcgctcttgcctttggaagctcactaaggaggggcaccgccgcttttgggaggagactcgtgtcttagcctttgctcaaagggagagaatccaagagtgcatgagtcagccagagttgttgacctctctctttgatctt

SEQ ID NO: 79 - protein, 826 aa, Homo sapiens
MEGAGGANDKKKISSERRKEKSRDAARSRRSKESEVFYELAHQLPLPHNVSSHLDKASVMRLTISYLRVRKLLDAGDLDIEDDMKAQMNCFYLKALDGFVMVLTDDGDMIYISDNVNKYMGLTQFELTGHSVFDFTHPCDHEEMREMLTHRNGLVKKGKEQNTQRSFFLRMKCTLTSRGRTMNIKSATWKVLHCTGHIHVYDTNSNQPQCGYKKPPMTCLVLICEPIPHPSNIEIPLDSKTFLSRHSLDMKFSYCDERITELMGYEPEELLGRSIYEYYHALDSDHLTKTHHDMFTKGQVTTGQYRMLAKRGGYVWVETQATVIYNTKNSQPQCIVCVNYVVSGIIQHDLIFSLQQTECVLKPVESSDMKMTQLFTKVESEDTSSLFDKLKKEPDALTLLAPAAGDTIISLDFGSNDTETDDQQLEEVPLYNDVMLPSPNEKLQNINLAMSPLPTAETPKPLRSSADPALNQEVALKLEPNPESLELSFTMPQIQDQTPSPSDGSTRQSSPEPNSPSEYCFYVDSDMVNEFKLELVEKLFAEDTEAKNPFSTQDTDLDLEMLAPYIPMDDDFQLRSFDQLSPLESSSASPESASPQSTVTVFQQTQIQEPTANATTTTATTDELKTVTKDRMEDIKILIASPSPTHIHKETTSATSSPYRDTQSRTASPNRAGKGVIEQTEKSHPRSPNVLSVALSQRTTVPEEELNPKILALQNAQRKRKMEHDGSLFQAVGIGTLLQQPDDHAATTSLSWKRVKGCKSSEQNGMEQKTIILIPSDLACRLLGQSMDESGLPQLTSYDCEVNAPIQGSRNLLQGEELLRALDQVN

SEQ ID NO: 80 - DNA, 2478 bp, Homo sapiens
atggagggcgccggcggcgcgaacgacaagaaaaagataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaac

SEQ ID NO: 81 - protein, 870 aa, Homo sapiens
MTADKEKKRSSSERRKEKSRDAARCRRSKETEVFYELAHELPLPHSVSSHLDKASIMRLAISFLRTHKLLSSVCSENESEAEADQQMDNLYLKALEGFIAVVTQDGDMIFLSENISKFMGLTQVELTGHSIFDFTHPCDHEEIRENLSLKNGSGFGKKSKDMSTERDFFMRMKCTVTNRGRTVNLKSATWKVLHCTGQVKVYNNCPPHNSLCGYKEPLLSCLIIMCEPIQHPSHMDIPLDSKTFLSRHSMDMKFTYCDDRITELIGYHPEELLGRSAYEFYHALDSENMTKSHQNLCTKGQVVSGQYRMLAKHGGYVWLETQGTVIYNPRNLQPQCIMCVNYVLSEIEKNDVVFSMDQTESLFKPHLMAMNSIFDSSGKGAVSEKSNFLFTKLKEEPEELAQLAPTPGDAIISLDFGNQNFEESSAYGKAILPPSQPWATELRSHSTQSEAGSLPAFTVPQAAAPGSTTPSATSSSSSCSTPNSPEDYYTSLDNDLKIEVIEKLFAMDTEAKDQCSTQTDFNELDLETLAPYIPMDGEDFQLSPICPEERLLAENPQSTPQHCFSAMTNIFQPLAPVAPHSPFLLDKFQQQLESKKTEPEHRPMSSIFFDAGSKASLPPCCGQASTPLSSMGGRSNTQWPPDPPLHFGPTKWAVGDQRTEFLGAAPLGPPVSPPHVSTFKTRSAKGFGARGPDVLSPAMVALSNKLKLKRQLEYEEQAFQDLSGGDPPGGSTSHLMWKRMKNLRGGSCPLMPDKPLSANVPNDKFTQNPMRGLGHPLRHLPLPQPPSAISPGENSKSRFPPQCYATQYQDYSLSSAHKVSGMASRLLGPSFESYLLPELTRYDCEVNVPVLGSSTLLQGGDLLRALDQAT

SEQ ID NO: 82 - DNA, 2610 bp, Homo sapiens
atgacagctgacaaggagaagaaaaggagtagctcggagaggaggaaggagaagtcccgggatgctgcgcggtgccggcggagcaaggagacggaggtgttctatgagctggcccatgagctgcctctgccccacagtgtgagctcccatctggacaaggcctccatcatgcgactggcaatcagcttcctgcgaacacacaagctcctctcctcagtttgctctgaaaacgagtccgaagccgaagctgaccagcagatggacaacttgtacctgaaagccttggagggtttcattgccgtggtgacccaagatggcgacatgatctttctgtcagaaaacatcagcaagttcatgggacttacacaggtggagctaacaggacatagtatctttgacttcactcatccctgcgaccatgaggagattcgtgagaacctgagtctcaaaaatggctctggttttgggaaaaaaagcaaagacatgtccacagagcgggacttcttcatgaggatgaagtgcacggtcaccaacagaggccgtactgtcaacctcaagtcagccacctggaaggtcttgcactgcacgggccaggtgaaagtctacaacaactgccctcctcacaatagtctgtgtggctacaaggagcccctgctgtcctgcctcatcatcatgtgtgaaccaatccagcacccatcccacatggacatccccctggatagcaagaccttcctgagccgccacagcatggacatgaagttcacctactgtgatgacagaatcacagaactgattggttaccaccctgaggagctgcttggccgctcagcctatgaattctaccatgcgctagactccgagaacatgaccaagagtcaccagaacttgtgcaccaagggtcaggtagtaagtggccagtaccggatgctcgcaaagcatgggggctacgtgtggctggagacccaggggacggtcatctacaaccctcgcaacctgcagccccagtgcatcatgtgtgtcaactacgtcctgagtgagattgagaagaatgacgtggtgttctccatggaccagactgaatccctgttcaagccccacctgatggccatgaacagcatctttgatagcagtggcaagggggctgtgtctgagaagagtaacttcctattcaccaagctaaaggaggagcccgaggagctggcccagctggctcccaccccaggagacgccatcatctctctggatttcgggaatcagaacttcgaggagtcctcagcctatggcaaggccatcctgcccccgagccagccatgggccacggagttgaggagccacagcacccagagcgaggctgggagcctgcctgccttcaccgtgccccaggcagctgccccgggcagcaccacccccagtgccaccagcagcagcagcagctgctccacgcccaatagccctgaagactattacacatctttggataacgacctgaagattgaagtgattgagaagctcttcgccatggacacagaggccaaggaccaatgcagtacccagacggatttcaatgagctggacttggagacactggcaccctatatccccatggacggggaagacttccagctaagccccatctgccccgaggagcggctcttggcggagaacccacagtccaccccccagcactgcttcagtgccatgacaaacatcttccagccactggcccctgtagccccgcacagtcccttcctcctggacaagtttcagcagcagctggagagcaagaagacagagcccgagcaccggcccatgtcctccatcttctttgatgccggaagcaaagcatccctgccaccgtgctgtggccaggccagcacccctctctcttccatggggggcagatccaatacccagtggcccccagatccaccattacattttgggcccacaaagtgggccgtcggggatcagcgcacagagttcttgggagcagcgccgttggggccccctgtctctccaccccatgtctccaccttcaagacaaggtctgcaaagggttttggggctcgaggcccagacgtgctgagtccggccatggtagccctctccaacaagctgaagctgaagcgacagctggagtatgaagagcaagccttccaggacctgagcgggggggacccacctggtggcagcacctcacatttgatgtggaaacggatgaagaacctcaggggtgggagctgccctttgatgccggacaagccactgagcgcaaatgtacccaatgataagttcacccaaaaccccatgaggggcctgggccatcccctgagacatctgccgctgccacagcctccatctgccatcagtcccggggagaacagcaagagcaggttccccccacagtgctacgccacccagtaccaggactacagcctgtcgtcagcccacaaggtgtcaggcatggcaagccggctgctcgggccctcatttgagtcctacctgctgcccgaactgaccagatatgactgtgaggtgaacgtgcccgtgctgggaagctccacgctcctgcaaggaggggacctcctcagagccctggaccaggccacc

SEQ ID NO: 83 - protein, 465 aa, Homo sapiens
MGEMLLLARCLLLVLVSSLLVCSGLACGPGRGFGKRRHPKKLTPLAYKQFIPNVAEKTLGASGRYEGKISRNSERFKELTPNYNPDIIFKDEENTGADRLMTQRCKDKLNALAISVMNQWPGVKLRVTEGWDEDGHHSEESLHYEGRAVDITTSDRDRSKYGMLARLAVEAGFDWVYYESKAHIHCSVKAENSVAAKSGGCFPGSATVHLEQGGTKLVKDLSPGDRVLAADDQGRLLYSDFLTFLDRDDGAKKVFYVIETREPRERLLLTAAHLLFVAPHNDSATGEPEASSGSGPPSGGALGPRALFASRVRPGQRVYVVAERDGDRRLLPAAVHSVTLSEEAAGAYAPLTAQGTILINRVLASCYAVIEEHSWAHRAFAPFRLAHALLAALAPARTDRGGDSGGGDRGGGGGRVALTAPGAADAPGAGATAGIHWYSQLLYQIGTWLLDSEALHPLGMAVKSS

SEQ ID NO: 84 - DNA, 1395 bp, Homo sapiens
atgggcgagatgctgctgctggcgagatgtctgctgctagtcctcgtctcctcgctgctggtatgctcgggactggcgtgcggaccgggcagggggttcgggaagaggaggcaccccaaaaagctgacccctttagcctacaagcagtttatccccaatgtggccgagaagaccctaggcgccagcggaaggtatgaagggaagatctccagaaactccgagcgatttaaggaactcacccccaattacaaccccgacatcatatttaaggatgaagaaaacaccggagcggacaggctgatgactcagaggtgtaaggacaagttgaacgctttggccatctcggtgatgaaccagtggccaggagtgaaactgcgggtgaccgagggctgggacgaagatggccaccactcagaggagtctctgcactacgagggccgcgcagtggacatcaccacgtctgaccgcgaccgcagcaagtacggcatgctggcccgcctggcggtggaggccggcttcgactgggtgtactacgagtccaaggcacatatccactgctcggtgaaagcagagaactcggtggcggccaaatcgggaggctgcttcccgggctcggccacggtgcacctggagcagggcggcaccaagctggtgaaggacctgagccccggggaccgcgtgctggcggcggacgaccagggccggctgctctacagcgacttcctcactttcctggaccgcgacgacggcgccaagaaggtcttctacgtgatcgagacgcgggagccgcgcgagcgcctgctgctcaccgccgcgcacctgctctttgtggcgccgcacaacgactcggccaccggggagcccgaggcgtcctcgggctcggggccgccttccgggggcgcactggggcctcgggcgctgttcgccagccgcgtgcgcccgggccagcgcgtgtacgtggtggccgagcgtgacggggaccgccggctcctgcccgccgctgtgcacagcgtgaccctaagcgaggaggccgcgggcgcctacgcgccgctcacggcccagggcaccattctcatcaaccgggtgctggcctcgtgctacgcggtcatcgaggagcacagctgggcgcaccgggccttcgcgcccttccgcctggcgcacgcgctcctggctgcactggcgcccgcgcgcacggaccgcggcggggacagcggcggcggggaccgcgggggcggcggcggcagagtagccctaaccgctccaggtgctgccgacgctccgggtgcgggggccaccgcgggcatccactggtactcgcagctgctctaccaaataggcacctggctcctggacagcgaggccctgcacccgctgggcatggcggtcaagtccagc

SEQ ID NO: 85 - protein, 396 aa, Homo sapiens
MALLTNLLPLCCLALLALPAQSCGPGRGPVGRRRYARKQLVPLLYKQFVPGVPERTLGASGPAEGRVARGSERFRDLVPNYNPDIIFKDEENSGADRLMTERCKERVNALAIAVMNMWPGVRLRVTEGWDEDGHHAQDSLHYEGRALDITTSDRDRNKYGLLARLAVEAGFDWVYYESRNHVHVSVKADNSLAVRAGGCFPGNATVRLWSGERKGLRELHRGDWVLAADASGRVVPTPVLLFLDRDLQRRASFVAVETEWPPRKLLLTPWHLVFAARGPAPAPGDFAPVFARRLRAGDSVLAPGGDALRPARVARVAREEAVGVFAPLTAHGTLLVNDVLASCYAVLESHQWAHRAFAPLRLLHALGALLPGGAVQPTGMHWYSRLLYRLAEELLG

SEQ ID NO: 86 - DNA, 1188 bp, Homo sapiens
atggctctcctgaccaatctactgcccctgtgctgcttggcacttctggcgctgccagcccagagctgcgggccgggccgggggccggttggccggcgccgctatgcgcgcaagcagctcgtgccgctactctacaagcaatttgtgcccggcgtgccagagcggaccctgggcgccagtgggccagcggaggggagggtggcaaggggctccgagcgcttccgggacctcgtgcccaactacaaccccgacatcatcttcaaggatgaggagaacagtggagccgaccgcctgatgaccgagcgttgtaaggagcgggtgaacgctttggccattgccgtgatgaacatgtggcccggagtgcgcctacgagtgactgagggctgggacgaggacggccaccacgctcaggattcactccactacgaaggccgtgctttggacatcactacgtctgaccgcgaccgcaacaagtatgggttgctggcgcgcctcgcagtggaagccggcttcgactgggtctactacgagtcccgcaaccacgtccacgtgtcggtcaaagctgataactcactggcggtccgggcgggcggctgctttccgggaaatgcaactgtgcgcctgtggagcggcgagcggaaagggctgcgggaactgcaccgcggagactgggttttggcggccgatgcgtcaggccgggtggtgcccacgccggtgctgctcttcctggaccgggacttgcagcgccgggcttcatttgtggctgtggagaccgagtggcctccacgcaaactgttgctcacgccctggcacctggtgtttgccgctcgagggccggcgcccgcgccaggcgactttgcaccggtgttcgcgcgccggctacgcgctggggactcggtgctggcgcccggcggggatgcgcttcggccagcgcgcgtggcccgtgtggcgcgggaggaagccgtgggcgtgttcgcgccgctcaccgcgcacgggacgctgctggtgaacgatgtcctggcctcttgctacgcggttctggagagtcaccagtgggcgcaccgcgcttttgcccccttgagactgctgcacgcgctaggggcgctgctccccggcggggccgtccagccgactggcatgcattggtactctcggctcctctaccgcttagcggaggagctactgggc

SEQ ID NO: 87 - protein, 411 aa, Homo sapiens
MSPARLRPRLHFCLVLLLLLVVPAAWGCGPGRVVGSRRRPPRKLVPLAYKQFSPNVPEKTLGASGRYEGKIARSSERFKELTPNYNPDIIFKDEENTGADRLMTQRCKDRLNSLAISVMNQWPGVKLRVTEGWDEDGHHSEESLHYEGRAVDITTSDRDRNKYGLLARLAVEAGFDWVYYESKAHVHCSVKSEHSAAAKTGGCFPAGAQVRLESGARVALSAVRPGDRVLAMGEDGSPTFSDVLIFLDREPHRLRAFQVIETQDPPRRLALTPAHLLFTADNHTEPAARFRATFASHVQPGQYVLVAGVPGLQPARVAAVSTHVALGAYAPLTKHGTLVVEDVVASCFAAVADHHLAQLAFWPLRLFHSLAWGSWTPGEGVHWYPQLLYRLGRLLLEEGSFHPLGMSGAGS

SEQ ID NO: 88 - DNA, 1233 bp, Homo sapiens
atgtctcccgcccggctccggccccgactgcacttctgcctggtcctgttgctgctgctggtggtgccggcggcatggggctgcgggccgggtcgggtggtgggcagccgccggcgaccgccacgcaaactcgtgccgctcgcctacaagcagttcagccccaatgtgcccgagaagaccctgggcgccagcggacgctatgaaggcaagatcgctcgcagctccgagcgcttcaaggagctcacccccaattacaatccagacatcatcttcaaggacgaggagaacacaggcgccgaccgcctcatgacccagcgctgcaaggaccgcctgaactcgctggctatctcggtgatgaaccagtggcccggtgtgaagctgcgggtgaccgagggctgggacgaggacggccaccactcagaggagtccctgcattatgagggccgcgcggtggacatcaccacatcagaccgcgaccgcaataagtatggactgctggcgcgcttggcagtggaggccggctttgactgggtgtattacgagtcaaaggcccacgtgcattgctccgtcaagtccgagcactcggccgcagccaagacaggcggctgcttccctgccggagcccaggtacgcctggagagtggggcgcgtgtggccttgtcagccgtgaggccgggagaccgtgtgctggccatgggggaggatgggagccccaccttcagcgatgtgctcattttcctggaccgcgagcctcacaggctgagagccttccaggtcatcgagactcaggaccccccacgccgcctggcactcacacccgctcacctgctctttacggctgacaatcacacggagccggcagcccgcttccgggccacatttgccagccacgtgcagcctggccagtacgtgctggtggctggggtgccaggcctgcagcctgcccgcgtggcagctgtctctacacacgtggccctcggggcctacgccccgctcacaaagcatgggacactggtggtggaggatgtggtggcatcctgcttcgcggccgtggctgaccaccacctggctcagttggccttctggcccctgagactctttcacagcttggcatggggcagctggaccccgggggagggtgtgcattggtacccccagctgctctaccgcctggggcgtctcctgctagaagagggcagcttccacccactgggcatgtccggggcagggagc

SEQ ID NO: 89 - protein, 436 aa, Homo sapiens
MSSPGTESAGKSLQYRVDHLLSAVENELQAGSEKGDPTERELRVGLEESELWLRFKELTNEMIVTKNGRRMFPVLKVNVSGLDPNAMYSFLLDFVAADNHRWKYVNGEWVPGGKPEPQAPSCVYIHPDSPNFGAHWMKAPVSFSKVKLTNKLNGGGQIMLNSLHKYEPRIHIVRVGGPQRMITSHCFPETQFIAVTAYQNEEITALKIKYNPFAKAFLDAKERSDHKEMMEEPGDSQQPGYSQSGGWLLPGTSTLCPPANPHPQFGGALSLPSTHSCDRYPTLRSHRSSPYPSPYAHRNNSPTYSDNSPACLSMLQSHDNWSSLGMPAHPSMLPVSHNASPPTSSSQYPSLWSVSNGAVTPGSQAAAVSNGLGAQFFRGSPAHYTPLTHPVSAPSSSGSPLYEGAAAATDIVDSQYDAAAQGRLIASWTPVSPPSM

SEQ ID NO: 90 - DNA, 1308 bp, Homo sapiens
atgagctcccctggcaccgagagcgcgggaaagagcctgcagtaccgagtggaccacctgctgagcgccgtggagaatgagctgcaggcgggcagcgagaagggcgaccccacagagcgcgaactgcgcgtgggcctggaggagagcgagctgtggctgcgcttcaaggagctcaccaatgagatgatcgtgaccaagaacggcaggaggatgtttccggtgctgaaggtgaacgtgtctggcctggaccccaacgccatgtactccttcctgctggacttcgtggcggcggacaaccaccgctggaagtacgtgaacggggaatgggtgccggggggcaagccggagccgcaggcgcccagctgcgtctacatccaccccgactcgcccaacttcggggcccactggatgaaggctcccgtctccttcagcaaagtcaagctcaccaacaagctcaacggagggggccagatcatgctgaactccttgcataagtatgagcctcgaatccacatagtgagagttgggggtccacagcgcatgatcaccagccactgcttccctgagacccagttcatagcggtgactgcttatcagaacgaggagatcacagctcttaaaattaagtacaatccatttgcaaaagctttccttgatgcaaaggaaagaagtgatcacaaagagatgatggaggaacccggagacagccagcaacctgggtactcccaatcaggggggtggcttcttcctggaaccagcaccctgtgtccacctgcaaatcctcatcctcagtttggaggtgccctctccctcccctccacgcacagctgtgacaggtacccaaccctgaggagccaccggtcctcaccctaccccagcccctatgctcatcggaacaattctccaacctattctgacaactcacctgcatgtttatccatgctgcaatcccatgacaattggtccagccttggaatgcctgcccatcccagcatgctccccgtgagccacaatgccagcccacctaccagctccagtcagtaccccagcctgtggtctgtgagcaacggcgccgtcaccccgggctcccaggcagcagccgtgtccaacgggctgggggcccagttcttccggggctcccccgcgcactacacacccctcacccatccggtctcggcgccctcttcctcgggatccccactgtacgaaggggcggccgcggccacagacatcgtggacagccagtacgacgccgcagcccaaggccgcctcatagcctcatggacacctgtgtcgccaccttccatg

SEQ ID NO: 91 - protein, 682 aa, Homo sapiens
MQLEHCLSPSIMLSKKFLNVSSSYPHSGGSELVLHDHPIISTTDNLERSSPLKKITRGMTNQSDTDNFPDSKDSPGDVQRSKLSPVLDGVSELRHSFDGSAADRYLLSQSSQPQSAATAPSAMFPYPGQHGPAHPAFSIGSPSRYMAHHPVITNGAYNSLLSNSSPQGYPTAGYPYPQQYGHSYQGAPFYQFSSTQPGLVPGKAQVYLCNRPLWLKFHRHQTEMIITKQGRRMFPFLSFNISGLDPTAHYNIFVDVILADPNHWRFQGGKWVPCGKADTNVQGNRVYMHPDSPNTGAHWMRQEISFGKLKLTNNKGASNNNGQMVVLQSLHKYQPRLHVVEVNEDGTEDTSQPGRVQTFTFPETQFIAVTAYQNTDITQLKIDHNPFAKGFRDNYDTIYTGCDMDRLTPSPNDSPRSQIVPGARYAMAGSFLQDQFVSNYAKARFHPGAGAGPGPGTDRSVPHTNGLLSPQQAEDPGAPSPQRWFVTPANNRLDFAASAYDTATDFAGNAATLLSYAAAGVKALPLQAAGCTGRPLGYYADPSGWGARSPPQYCGTKSGSVLPCWPNSAAAAARMAGANPYLGEEAEGLAAERSPLPPGAAEDAKPKDLSDSSWIETPSSIKSIDSSDSGIYEQAKRRRISPADTPVSESSSPLKSEVLAQRDCEKNCAKDISGYYGFYSHS

SEQ ID NO: 92 - DNA, 2046 bp, Homo sapiens
atgcagctggagcactgcctttctccttctatcatgctctccaagaaatttctcaatgtgagcagcagctacccacattcaggcggatccgagcttgtcttgcacgatcatcccattatctcgaccactgacaacctggagagaagttcacctttgaaaaaaattaccagggggatgacgaatcagtcagatacagacaattttcctgactccaaggactcaccaggggacgtccagagaagtaaactctctcctgtcttggacggggtctctgagcttcgtcacagtttcgatggctctgctgcagatcgctacctcctctctcagtccagccagccacagtctgcggccactgctcccagtgccatgttcccgtaccccggccagcacggaccggcgcaccccgccttctccatcggcagccctagccgctacatggcccaccacccggtcatcaccaacggagcctacaacagcctcctgtccaactcctcgccgcagggataccccacggccggctacccctacccacagcagtacggccactcctaccaaggagctccgttctaccagttctcctccacccagccggggctggtgcccggcaaagcacaggtgtacctgtgcaacaggcccctttggctgaaatttcaccggcaccaaacggagatgatcatcaccaaacagggaaggcgcatgtttccttttttaagttttaacatttctggtctcgatcccacggctcattacaatatttttgtggatgtgattttggcggatcccaatcactggaggtttcaaggaggcaaatgggttccttgcggcaaagcggacaccaatgtgcaaggaaatcgggtctatatgcatccggattcccccaacactggggctcactggatgcgccaagaaatctcttttggaaaattaaaacttacgaacaacaaaggagcttcaaataacaatgggcagatggtggttttacagtccttgcacaagtaccagccccgcctgcatgtggtggaagtgaacgaggacggcacggaggacactagccagcccggccgcgtgcagacgttcactttccctgagactcagttcatcgccgtcaccgcctaccagaacacggatattacacaactgaaaatagatcacaacccttttgcaaaaggatttcgggataattatgacacgatctacaccggctgtgacatggaccgcctgaccccctcgcccaacgactcgccgcgctcgcagatcgtgcccggggcccgctacgccatggccggctctttcctgcaggaccagttcgtgagcaactacgccaaggcccgcttccacccgggcgcgggcgcgggccccgggccgggtacggaccgcagcgtgccgcacaccaacgggctgctgtcgccgcagcaggccgaggacccgggcgcgccctcgccgcaacgctggtttgtgacgccggccaacaaccggctggacttcgcggcctcggcctatgacacggccacggacttcgcgggcaacgcggccacgctgctctcttacgcggcggcgggcgtgaaggcgctgccgctgcaggctgcaggctgcactggccgcccgctcggctactacgccgacccgtcgggctggggcgcccgcagtcccccgcagtactgcggcaccaagtcgggctcggtgctgccctgctggcccaacagcgccgcggccgccgcgcgcatggccggcgccaatccctacctgggcgaggaggccgagggcctggccgccgagcgctcgccgctgccgcccggcgccgccgaggacgccaagcccaaggacctgtccgattccagctggatcgagacgccctcctcgatcaagtccatcgactccagcgactcggggatttacgagcaggccaagcggaggcggatctcgccggccgacacgcccgtgtccgagagttcgtccccgctcaagagcgaggtgctggcccagcgggactgcgagaagaactgcgccaaggacattagcggctactatggcttctactcgcacagc

SEQ ID NO: 93 - protein, 494 aa, Homo sapiens
MHFSTVTRDMEAFTASSLSSLGAAGGFPGAASPGADPYGPREPPPPPRYDPCAAAAPGAPGPPPPPHAYPFAPAAGAATSAAAEPEGPGASCAAAAKAPVKKNAKVAGVSVQLEMKALWDEFNQLGTEMIVTKAGRRMFPTFQVKLFGMDPMADYMLLMDFVPVDDKRYRYAFHSSSWLVAGKADPATPGRVHYHPDSPAKGAQWMKQIVSFDKLKLTNNLLDDNGHIILNSMHRYQPRFHVVYVDPRKDSEKYAEENFKTFVFEETRFTAVTAYQNHRITQLKIASNPFAKGFRDCDPEDWPRNHRPGALPLMSAFARSRNPVASPTQPSGTEKDAAEARREFQRDAGGPAVLGDPAHPPQLLARVLSPSLPGAGGAGGLVPLPGAPGGRPSPPNPELRLEAPGASEPLHHHPYKYPAAAYDHYLGAKSRPAPYPLPGLRGHGYHPHAHPHHHHHPVSPAAAAAAAAAAAAAAANMYSSAGAAPPGSYDYCPR

SEQ ID NO: 94 - DNA, 1482 bp, Homo sapiens
atgcacttcagcaccgtcaccagggacatggaagccttcacggccagcagcctgagcagcctgggggccgcggggggcttcccgggcgccgcgtcgcccggcgccgacccgtacggcccgcgcgagcccccgccgccgccgcgctacgacccgtgcgccgccgccgcccccggcgccccgggtccgccgccgccgccgcacgcctacccgtttgcgccggccgccggggccgccaccagcgccgccgccgagcccgagggccccggggccagctgcgcggccgcagccaaggcgccggtgaagaagaacgcgaaggtggccggtgtgagcgtgcagctagagatgaaggcgctgtgggacgagttcaaccagctgggcaccgagatgatcgtcaccaaggccggcaggcggatgtttcccaccttccaagtgaagctcttcggcatggatcccatggccgactatatgctgctcatggacttcgtgccggtggacgataagcgctaccggtacgccttccacagctcctcctggctggtggcggggaaggccgaccctgccacgccaggccgcgtgcactaccacccggactcgcctgccaagggcgcgcagtggatgaagcaaatcgtgtccttcgacaagctcaagctgaccaacaacttactggacgacaacggccacattattctgaattccatgcacagataccagccccgcttccacgtggtctatgtggacccacgcaaagatagcgagaaatatgccgaggagaacttcaaaacctttgtgttcgaggagacacgattcaccgcggtcactgcctaccagaaccatcggatcacgcagctcaagattgccagcaatcccttcgcgaaaggcttccgggactgtgaccctgaggactggccccggaaccaccggcccggcgcactgccgctcatgagcgccttcgcgcgctcgcggaaccccgtggcttccccgacgcagcccagcggcacggagaaagacgcggctgaggcccggcgagaattccagcgcgacgcgggcgggccagcggtgctcggggacccggcgcatcctccgcagctgctggcccgggtgctaagcccctcgctgcccggggccggcggcgccggcggcttagtcccgctgcccggcgcgcccggaggccggcccagtcccccgaaccccgagctgcgcctggaggcgcccggcgcatcggagccgctgcaccaccacccctacaaatatccggccgccgcctacgaccactatctcggggccaagagccggccggcgccctacccgctgcccggcctgcgtggccacggctaccacccgcacgcgcatccgcaccaccaccaccaccccgtgagtccagccgccgcggccgccgccgccgctgccgcagctgccgcggccgccaacatgtactcgtcggccggagccgcgccgcccggctcctacgactattgccccaga

SEQ ID NO: 95 - protein, 712 aa, Homo sapiens
MREPALAASAMAYHPFHAPRPADFPMSAFLAAAQPSFFPALALPPGALAKPLPDPGLAGAAAAAAAAAAAAEAGLHVSALGPHPPAAHLRSLKSLEPEDEVEDDPKVTLEAKELWDQFHKLGTEMVITKSGRRMFPPFKVRVSGLDKKAKYILLMDIVAADDCRYKFHNSRWMVAGKADPEMPKRMYIHPDSPATGEQWMAKPVAFHKLKLTNNISDKHGFTILNSMHKYQPRFHIVRANDILKLPYSTFRTYVFPETDFIAVTAYQNDKITQLKIDNNPFAKGFRDTGNGRREKRKQLTLPSLRLYEEHCKPERDGAESDASSCDPPPAREPPTSPGAAPSPLRLHRARAEEKSCAADSDPEPERLSEERAGAPLGRSPAPDSASPTRLTEPERARERRSPERGKEPAESGGDGPFGLRSLEKERAEARRKDEGRKEAAEGKEQGLAPLVVQTDSASPLGAGHLPGLAFSSHLHGQQFFGPLGAGQPLFLHPGQFTMGPGAFSAMGMGHLLASVAGGGNGGGGGPGTAAGLDAGGLGPAASAASTAAPFPFHLSQHMLASQGIPMPTFGGLFPYPYTYMAAAAAAASALPATSAAAAAAAAAGSLSRSPFLGSARPRLRFSPYQIPVTIPPSTSLLTTGLASEGSKAAGGNSREPSPLPELALRKVGAPSRGALSPSGSAKEAANELQSIQRLVSGLESQRALSPGRESPK

SEQ ID NO: 96 - DNA, 2136 bp, Homo sapiens
atgagagagccggcgctggcggccagcgccatggcttaccacccgttccacgcgccacggcccgccgacttccccatgtccgcctttctggcggcggcgcagccctccttcttcccggcactcgcgctgccgcccggcgcgctggccaagccgctgcccgacccgggcctggcgggggcggcggccgcggcggcggcggcggcagcagcggccgaggcggggctgcacgtctcggcactgggcccgcacccgcccgccgcgcatctgcgctccctcaagagcctggagcccgaggacgaggtggaggacgaccccaaggtgacgctggaggccaaggagctgtgggaccagttccacaagctaggcacggagatggtcatcaccaagtccgggaggcggatgttcccccccttcaaggtgcgagtcagcggcctggacaagaaggccaagtatatcctgctgatggacattgtagccgctgacgattgccgctataagttccacaactcgcgctggatggtggcgggcaaggccgaccctgagatgcccaaacgcatgtacatccacccagacagcccagccacgggggagcagtggatggctaagcctgtggccttccacaagctgaagctgaccaacaacatctctgacaagcacggcttcaccatcctaaactccatgcacaagtaccagccgcgcttccacatagtgcgagccaacgacatcctgaagctgccttacagcaccttccgcacctacgtgttcccggagaccgacttcatcgccgtcactgcctaccagaatgacaagatcacacagctgaagatcgacaacaacccgtttgccaagggcttccgggacaccgggaacggccggcgggagaaaaggaagcagctgacgctgccgtctctacgcttgtacgaggagcactgcaaacccgagcgcgatggcgcggagtcagacgcctcgtcgtgcgaccctccccccgcgcgggaaccacccacctccccgggcgcagcgcccagtccgctgcgcctgcaccgggcccgagctgaggagaagtcgtgcgccgcggacagcgacccggagcctgagcggttgagcgaggagcgtgcgggggcgccgctaggccgcagcccggctccagacagcgccagccccactcgcttgaccgaacccgagcgcgcccgggagcggcgtagtcccgagaggggcaaggagccggccgagagcggcggggacggcccgttcggcctgaggagcctggagaaggagcgcgccgaagctcggaggaaggacgaggggcgcaaggaggcggccgagggcaaggagcagggcctggcgccgctggtggtgcagacagacagtgcgtcccccctgggcgccggacacctgcccggcctggccttttccagccacttgcacgggcagcagttctttgggccgctgggagccggccagccgctcttcctgcaccctggacagttcaccatgggccctggcgccttctccgccatgggcatgggtcacctactggcctcggtggcaggcggcggcaacggcggaggtggcgggcctgggaccgccgcggggctggacgcaggcgggctgggtcccgcggccagcgcagcaagcaccgccgcgcccttcccgttccacctctcccagcacatgctggcatctcagggaattccaatgcccactttcggaggcctcttcccctacccctacacctacatggcagcagcagccgcagccgcctcggctttgcccgccactagtgctgcagctgccgccgccgcagccgccggctccctctcccggagccccttcctgggcagtgcccggccccgactgcgtttcagcccctatcagatcccggtcaccatcccgcctagcactagcctcctcaccaccgggctggcctctgagggctccaaggccgctggtggaaacagccgggagcctagccccctgcccgagctggctctccgcaaagtaggggccccatcccgcggtgccctgtcgcccagtggctcggccaaggaggcggccaatgaactgcagagcatccagagactggtgagtgggctggagagccagcgagccctctccccaggccgggagtcgcccaag

SEQ ID NO: 97 - protein, 743 aa, Homo sapiens
MSLSMRDPVIPGTSMAYHPFLPHRAPDFAMSAVLGHQPPFFPALTLPPNGAAALSLPGALAKPIMDQLVGAAETGIPFSSLGPQAHLRPLKTMEPEEEVEDDPKVHLEAKELWDQFHKRGTEMVITKSGRRMFPPFKVRCSGLDKKAKYILLMDIIAADDCRYKFHNSRWMVAGKADPEMPKRMYIHPDSPATGEQWMSKVVTFHKLKLTNNISDKHGFTLAFPSDHATWQGNYSFGTQTILNSMHKYQPRFHIVRANDILKLPYSTFRTYLFPETEFIAVTAYQNDKITQLKIDNNPFAKGFRDTGNGRREKRKQLTLQSMRVFDERHKKENGTSDESSSEQAAFNCFAQASSPAASTVGTSNLKDLCPSEGESDAEAESKEEHGPEACDAAKISTTTSEEPCRDKGSPAVKAHLFAAERPRDSGRLDKASPDSRHSPATISSSTRGLGAEERRSPVREGTAPAKVEEARALPGKEAFAPLTVQTDAAAAHLAQGPLPGLGFAPGLAGQQFFNGHPLFLHPSQFAMGGAFSSMAAAGMGPLLATVSGASTGVSGLDSTAMASAAAAQGLSGASAATLPFHLQQHVLASQGLAMSPFGSLFPYPYTYMAAAAAASSAAASSSVHRHPFLNLNTMRPRLRYSPYSIPVPVPDGSSLLTTALPSMAAAAGPLDGKVAALAASPASVAVDSGSELNSRSSTLSSSSMSLSPKLCAEKEAATSELQSIQRLVSGLEAKPDRSRSASP

SEQ ID NO: 98 - DNA, 2229 bp, Homo sapiens
atgagcctctccatgagagatccggtcattcctgggacaagcatggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggatcaattggtgggggcggccgagaccggcatcccgttctcctccctggggccccaggcgcatctgaggcctttgaagaccatggagcccgaagaagaggtggaggacgaccccaaggtgcacctggaggctaaagaactttgggatcagtttcacaagcggggcaccgagatggtcattaccaagtcgggaaggcgaatgtttcctccatttaaagtgagatgttctgggctggataaaaaagccaaatacattttattgatggacattatagctgctgatgactgtcgttataaatttcacaattctcggtggatggtggctggtaaggccgaccccgaaatgccaaagaggatgtacattcacccggacagccccgctactggggaacagtggatgtccaaagtcgtcactttccacaaactgaaactcaccaacaacatttcagacaaacatggatttactttggccttcccaagtgatcacgctacgtggcaggggaattatagttttggtactcagactatattgaactccatgcacaaataccagccccggttccacattgtaagagccaatgacatcttgaaactcccttatagtacatttcggacatacttgttccccgaaactgaattcatcgctgtgactgcataccagaatgataagataacccagttaaaaatagacaacaacccttttgcaaaaggtttccgggacactggaaatggccgaagagaaaaaagaaaacagctcaccctgcagtccatgagggtgtttgatgaaagacacaaaaaggagaatgggacctctgatgagtcctccagtgaacaagcagctttcaactgcttcgcccaggcttcttctccagccgcctccactgtagggacatcgaacctcaaagatttatgtcccagcgagggtgagagcgacgccgaggccgagagcaaagaggagcatggccccgaggcctgcgacgcggccaagatctccaccaccacgtcggaggagccctgccgtgacaagggcagccccgcggtcaaggctcaccttttcgctgctgagcggccccgggacagcgggcggctggacaaagcgtcgcccgactcacgccatagccccgccaccatctcgtccagcactcgcggcctgggcgcggaggagcgcaggagcccggttcgcgagggcacagcgccggccaaggtggaagaggcgcgcgcgctcccgggcaaggaggccttcgcgccgctcacggtgcagacggacgcggccgccgcgcacctggcccagggccccctgcctggcctcggcttcgccccgggcctggcgggccaacagttcttcaacgggcacccgctcttcctgcaccccagccagtttgccatggggggcgccttctccagcatggcggccgctggcatgggtcccctcctggccacggtttctggggcctccaccggtgtctcgggcctggattccacggccatggcctctgccgctgcggcgcagggactgtccggggcgtccgcggccaccctgcccttccacctccagcagcacgtcctggcctctcagggcctggccatgtcccctttcggaagcctgttcccttacccctacacgtacatggccgcagcggcggccgcctcctctgcggcagcctccagctcggtgcaccgccaccccttcctcaatctgaacaccatgcgcccgcggctgcgctacagcccctactccatcccggtgccggtcccggacggcagcagtctgctcaccaccgccctgccctccatggcggcggccgcggggcccctggacggcaaagtcgccgccctggccgccagcccggcctcggtggcagtggactcgggctctgaactcaacagccgctcctccacgctctcctccagctccatgtccttgtcgcccaaactctgcgcggagaaagaggcggccaccagcgaactgcagagcatccagcggttggttagcggcttggaagccaagccggacaggtcccgcagcgcgtccccg

SEQ ID NO: 99 - protein, 545 aa, Homo sapiens
MLQDKGLSESEEAFRAPGPALGEASAANAPEPALAAPGLSGAALGSPPGPGADVVAAAAAEQTIENIKVGLHEKELWKKFHEAGTEMIITKAGRRMFPSYKVKVTGMNPKTKYILLIDIVPADDHRYKFCDNKWMVAGKAEPAMPGRLYVHPDSPATGAHWMRQLVSFQKLKLTNNHLDPFGHIILNSMHKYQPRLHIVKADENNAFGSKNTAFCTHVFPETSFISVTSYQNHKITQLKIENNPFAKGFRGSDDSDLRVARLQSKEYPVISKSIMRQRLISPQLSATPDVGPLLGTHQALQHYQHENGAHSQLAEPQDLPLSTFPTQRDSSLFYHCLKRRDGTRHLDLPCKRSYLEAPSSVGEDHYFRSPPPYDQQMLSPSYCSEVTPREACMYSGSGPEIAGVSGVDDLPPPPLSCNMWTSVSPYTSYSVQTMETVPYQPFPTHFTATTMMPRLPTLSAQSSQPPGNAHFSVYNQLSQSQVRERGPSASFPRERGLPQGCERKPPSPHLNAANEFLYSQTFSLSRESSLQYHSGMGTVENWTDG

SEQ ID NO: 100 - DNA, 1635 bp, Homo sapiens
atgctgcaggataagggcctgtccgagagcgaggaggccttccgggccccgggcccagcgctcggagaggccagcgcagccaacgcccccgagcccgcgctggcagcgccgggcctcagcggagccgcgctaggcagccccccgggacccggggccgacgtcgtcgccgccgccgccgcggagcagaccatcgagaacatcaaggtggggctgcatgagaaggagctctggaagaagttccacgaggcgggcaccgagatgatcatcactaaggctggcaggaggatgttccccagctacaaggtaaaagtcacaggcatgaaccccaagaccaagtatatcctgctgattgacattgtccctgccgatgaccatcgctacaagttctgtgacaacaaatggatggtggcagggaaggctgagccagccatgccaggaaggctgtatgtccacccggattctcctgccacaggagcccactggatgcggcagctggtctccttccagaagctgaagctgacaaacaaccacctggacccctttggccatatcatcctcaactctatgcacaagtaccagccgcggctccacatcgttaaggctgatgagaacaatgctttcggctccaaaaacactgctttctgcacccacgtgttcccagagacctccttcatctctgtgacctcctaccagaatcacaagatcacccagctgaaaattgagaacaacccttttgccaagggattccggggcagtgatgacagtgacctgcgtgtggcccgactgcagagcaaagaataccccgtgatttccaaaagcatcatgaggcagaggctcatctccccccagctctcagccacaccggacgtgggccccctgctcggcacccaccaggcactccagcactaccagcacgagaacggggcacactcacagctcgcggagccgcaggacctgcccctcagcacctttcccacccagagggactcaagcctcttctatcactgcctgaaaagacgagacggtacccgccacctggacttaccttgcaagcgatcctatctggaagccccctcttcggtgggggaggatcactatttccgttccccccctccctacgaccagcaaatgctgagcccctcctactgcagtgaggtgacccccagagaagcatgtatgtactcaggttcagggcccgagattgccggggtgtctggggtggacgacctgcccccacctccgctgagctgtaacatgtggacttcagtgtcgccgtacaccagctatagcgtgcagacgatggagactgtgccgtaccagcccttccccacgcacttcaccgccaccaccatgatgccgcggctgcccaccctctccgctcagagctcccagccaccaggaaatgcccactttagtgtctacaatcagctctcccagtctcaggtccgagagcgggggcccagcgcctcattcccaagagagcgcggcctcccccaagggtgtgagaggaagccaccctcgccacatctaaatgctgccaatgagtttctctactctcaaaccttctccttgtcccgagaatcttccttacagtaccattcaggaatggggactgtggagaactggactgacgga

SEQ ID NO: 101 - protein, 518 aa, Homo sapiens
MADADEGFGLAHTPLEPDAKDLPCDSKPESALGAPSKSPSSPQAAFTQQGMEGIKVFLHERELWLKFHEVGTEMIITKAGRRMFPSYKVKVTGLNPKTKYILLMDIVPADDHRYKFADNKWSVTGKAEPAMPGRLYVHPDSPATGAHWMRQLVSFQKLKLTNNHLDPFGHIILNSMHKYQPRLHIVKADENNGFGSKNTAFCTHVFPETAFIAVTSYQNHKITQLKIENNPFAKGFRGSDDMELHRMSRMQSKEYPVVPRSTVRQKVASNHSPFSSESRALSTSSNLGSQYQCENGVSGPSQDLLPPPNPYPLPQEHSQIYHCTKRKEEECSTTDHPYKKPYMETSPSEEDSFYRSSYPQQQGLGASYRTESAQRQACMYASSAPPSEPVPSLEDISCNTWPSMPSYSSCTVTTVQPMDRLPYQHFSAHFTSGPLVPRLAGMANHGSPQLGEGMFQHQTSVAHQPVVRQCGPQTGLQSPGTLQPPEFLYSHGVPRTLSPHQYHSVHGVGMVPEWSDNS

SEQ ID NO: 102 - DNA, 1554 bp, Homo sapiens
atggccgacgcagacgagggctttggcctggcgcacacgcctctggagcctgacgcaaaagacctgccctgcgattcgaaacccgagagcgcgctcggggcccccagcaagtccccgtcgtccccgcaggccgccttcacccagcagggcatggagggaatcaaagtgtttctccatgaaagagaactgtggctaaaattccacgaagtgggcacggaaatgatcataaccaaggctggaaggcggatgtttcccagttacaaagtgaaggtgacgggccttaatcccaaaacgaagtacattcttctcatggacattgtacctgccgacgatcacagatacaaattcgcagataataaatggtctgtgacgggcaaagctgagcccgccatgcctggccgcctgtacgtgcacccagactcccccgccaccggggcgcattggatgaggcagctcgtctccttccagaaactcaagctcaccaacaaccacctggacccatttgggcatattattctaaattccatgcacaaataccagcctagattacacatcgtgaaagcggatgaaaataatggatttggctcaaaaaatacagcgttctgcactcacgtctttcctgagactgcgtttatagcagtgacttcttaccagaaccacaagatcacgcaattaaagattgagaataatccctttgccaaaggatttcggggcagtgatgacatggagctgcacagaatgtcaagaatgcaaagtaaagaatatcccgtggtccccaggagcaccgtgaggcaaaaagtggcctccaaccacagtcctttcagcagcgagtctcgagctctctccacctcatccaatttggggtcccaataccagtgtgagaatggtgtttccggcccctcccaggacctcctgcctccacccaacccatacccactgccccaggagcatagccaaatttaccattgtaccaagaggaaagaggaagaatgttccaccacagaccatccctataagaagccctacatggagacatcacccagtgaagaagattccttctaccgctctagctatccacagcagcagggcctgggtgcctcctacaggacagagtcggcacagcggcaagcttgcatgtatgccagctctgcgccccccagcgagcctgtgcccagcctagaggacatcagctgcaacacgtggccaagcatgccttcctacagcagctgcaccgtcaccaccgtgcagcccatggacaggctaccctaccagcacttctccgctcacttcacctcggggcccctggtccctcggctggctggcatggccaaccatggctccccacagctgggagagggaatgttccagcaccagacctccgtggcccaccagcctgtggtcaggcagtgtgggcctcagactggcctgcagtcccctggcacccttcagccccctgagttcctctactctcatggcgtgccaaggactctatcccctcatcagtaccactctgtgcacggagttggcatggtgccagagtggagcgacaatagc

SEQ ID NO: 103 - protein, 295 aa, Homo sapiens
MYHPRELYPSLGAGYRLGPAQPGADSSFPPALAEGYRYPELDTPKLDCFLSGMEAAPRTLAAHPPLPLLPPAMGTEPAPSAPEALHSLPGVSLSLENRELWKEFSSVGTEMIITKAGRRMFPACRVSVTGLDPEARYLFLLDVIPVDGARYRWQGRRWEPSGKAEPRLPDRVYIHPDSPATGAHWMRQPVSFHRVKLTNSTLDPHGHLILHSMHKYQPRIHLVRAAQLCSQHWGGMASFRFPETTFISVTAYQNPQITQLKIAANPFAKGFRENGRNCKRWELFIHLFMHSTNVY

SEQ ID NO: 104 - DNA, 885 bp, Homo sapiens
atgtaccatccacgagaattgtacccgtccctgggggccggctaccgcctggggcccgcccaacctggggccgactccagcttcccacccgccctagcggagggctaccgctaccccgaactggacacccctaaactggattgcttcctctccgggatggaggctgctccccgcaccctggccgcgcacccacctctgccccttctgccccctgccatgggcactgagccggccccatcagctccagaggccctccattccctcccgggggtcagcctgagcctggagaaccgggagctatggaaggagttcagctctgtgggaacagaaatgatcatcaccaaagctgggaggcgcatgttccctgcctgccgagtgtcagtcactggcctggaccccgaggcccgctacttgtttcttctggatgtgattccggtggatggggctcgctaccgctggcagggccggcgctgggagcccagcggcaaggcagagccccgcctgcctgaccgtgtctacattcaccccgactctcctgccactggtgcacattggatgcggcagcctgtgtctttccatcgtgtcaagctcaccaacagcacgctggacccccacggccacctgatcctgcactccatgcacaagtaccaaccccgcatacacctagttcgggcagcccagctctgcagccagcactgggggggcatggcctccttccgcttccccgagaccacattcatctccgtgacagcctaccagaacccacagatcacacaactgaagattgcagccaatccctttgccaaaggcttccgggagaacggcagaaactgtaagaggtgggagttgttcattcatttgttcatgcattcaacaaatgtttat

SEQ ID NO: 105 - protein, 385 aa, Homo sapiens
MAAFLSAGLGILAPSETYPLPTTSSGWEPRLGSPFPSGPCTSSTGAQAVAEPTGQGPKNPRVSRVTVQLEMKPLWEEFNQLGTEMIVTKAGRRMFPPFQVKILGMDSLADYALLMDFIPLDDKRYRYAFHSSAWLVAGKADPATPGRVHFHPDSPAKGAQWMRQIVSFDKLKLTNNLLDDNGHIILNSMHRYQPRFHVVFVDPRKDSERYAQENFKSFIFTETQFTAVTAYQNHRITQLKIASNPFAKGFRESDLDSWPVAPRPLLSVPARSHSSLSPCVLKGATDREKDPNKASASTSKTPAWLHHQLLPPPEVLLAPATYRPVTYQSLYSGAPSHLGIPRTRPAPYPLPNIRADRDQGGLPLPAGLGLLSPTVVCLGPGQDSQ

SEQ ID NO: 106 - DNA, 1155 bp, Homo sapiens
atggcagccttcctatctgctggcctcggcatacttgcaccctcagagacctaccccctacctacaaccagctctggctgggagccccggctggggtcaccattcccatcaggcccttgcaccagctctactggggcccaagctgtggccgagcccactgggcagggccccaagaacccacgtgtgtccagagtgacagttcagctggagatgaagcctctgtgggaggaattcaaccagctgggcactgagatgatcgtcaccaaggcaggcaggaggatgttcccccccttccaggtgaagatcctgggcatggactccctggccgactacgccctgctcatggacttcatccccctggacgacaagagatacaggtatgccttccacagctcggcctggctggtggcgggcaaggcagacccagccacacctggccgcgtgcacttccaccccgactcgccagccaagggtgcccagtggatgcgccagattgtgtcctttgacaagctcaagctgaccaacaacctgctggatgacaatggccacatcattctcaactctatgcaccgctaccagccccgtttccacgtggtcttcgtggacccacgcaaggacagtgagcgctatgcccaggagaacttcaagtccttcatcttcacagagacccagttcacagcagtgacagcctatcagaaccacaggatcacccagctgaaaatcgccagcaacccttttgccaaaggctttagagagagtgacctggactcctggcctgtggccccacggcccctgctcagtgtcccagcccggagtcacagcagcctcagtccctgtgtgctgaagggtgccacagacagggagaaagaccccaacaaagcttcagcttccacctccaagacccctgcttggctccatcatcagctgctgcccccacctgaggtcctgctggccccggccacctacaggcctgtcacgtatcagagcctgtactctggagccccgagccacctagggatcccaaggacccgaccagcaccataccccctccccaacatccgggctgatagggatcaaggaggcctgcctctcccagctgggctggggctcctgtcccccactgtggtgtgcctggggcctggccaggactcccag

SEQ ID NO: 107 - protein, 496 aa, Homo sapiens
MSSMEEIQVELQCADLWKRFHDIGTEMIITKAGRRMFPAMRVKITGLDPHQQYYIAMDIVPVDNKRYRYVYHSSKWMVAGNADSPVPPRVYIHPDSLASGDTWMRQVVSFDKLKLTNNELDDQGHIILHSMHKYQPRVHVIRKDFSSDLSPTKPVPVGDGVKTFNFPETVFTTVTAYQNQQITRLKIDRNPFAKGFRDSGRNRTGLEAIMETYAFWRPPVRTLTFEDFTTMQKQQGGSTGTSPTTSSTGTPSPSASSHLLSPSCSPPTFHLAPNTFNVGCRESQLCNLNLSDYPPCARSNMAALQSYPGLSDSGYNRLQSGTTSATQPSETFMPQRTPSLISGIPTPPSLPGNSKMEAYGGQLGSFPTSQFQYVMQAGNAASSSSSPHMFGGSHMQQSSYNAFSLHNPYNLYGYNFPTSPRLAASPEKLSASQSTLLCSSPSNGAFGERQYLPSGMEHSMHMISPSPNNQQATNTCDGRQYGAVPGSSSQMSVHMV

SEQ ID NO: 108 - DNA, 1488 bp, Homo sapiens
atgtcttccatggaggagattcaggtggagctgcaatgtgctgacctctggaagcggttccatgatattggaactgaaatgatcatcaccaaagcaggcaggaggatgtttcctgccatgagagtgaaaatcactggcctagatccacatcagcagtactacatagcaatggacattgtgcctgtggacaataaaagatacagatatgtgtatcatagctccaagtggatggtggctggcaatgctgattcccctgtgcccccaagagtttatatacaccctgattctctagcttctggagacacctggatgagacaggtggtcagttttgacaaactcaagcttaccaacaatgagttggatgatcaaggacatatcattctgcactctatgcacaaataccagcctcgagttcatgtgattcgcaaagacttcagcagtgacctttcacccactaagcctgttcctgttggggatggggtgaaaacgttcaactttcctgagactgtgttcaccacagttacggcctatcagaatcagcagattaccagattaaaaattgaccgaaacccttttgctaaaggattcagagattctgggagaaacagaactggacttgaagccatcatggagacatatgcattctggagacctcctgtgcgcacactcaccttcgaagacttcaccaccatgcagaagcagcaaggaggcagcacaggcacttccccaaccacctccagcactgggacaccatccccttcggcttcttctcatcttttatctccatcctgttctcctccaacttttcatctggcccccaacactttcaatgtgggctgccgagaaagccagctgtgtaatctaaacctctctgattatccaccatgtgcccgaagcaacatggctgccttgcagagctacccagggctgagtgacagtggctacaacaggcttcagagtggcaccacttcagccactcagccctctgaaaccttcatgcctcagaggactccatccctgatctcaggaataccaactcctccctcgttgcctggcaacagcaagatggaagcctacggtggccagctggggtcctttcccacttcccagtttcagtatgtcatgcaggcaggcaatgctgcctccagctcctcatcaccacacatgttcgggggcagccacatgcagcagagctcctacaatgccttctcccttcacaacccttacaacctgtatggatacaatttccccacttcccctaggctagctgcaagcccggaaaaactgagcgcctctcaaagcactttactctgttcttctccttccaacggggcctttggagagaggcagtacctgccgtcagggatggagcacagcatgcacatgattagtccttcacccaataaccaacaggcaaccaacacttgtgatggccggcagtatggggcagttccaggctcctcctcccagatgtccgtgcacatggtt

SEQ ID NO: 109 - protein, 607 aa, Homo sapiens [sequence omitted]

SEQ ID NO: 110 - DNA, 1821 bp, Homo sapiens
atggccgagaagcgaaggggctcgccgtgcagcatgctaagcctcaaggcgcacgctttctcggtggaggcgctgatcggcgccgagaagcagcaacagcttcagaagaagcggcgaaaactgggcgccgaagaggcggcgagggccgtggacgacggaggctgcagccgcggcggcggcgcgggcgaaaagggttcttctgagggagacgaaggcgctgcgctcccgccgccggctggggcgacgtctgggccggctcggagtggcgcagacctggagcgcggagccgcgggcggctgtgaggacggcttccagcagggagcttcccctctggcgtcaccgggaggctcccccaaggggtctccggcgcgctccctggcccggcccgggacccctctgccctcgccgcaggccccgcgggtggatctgcagggagccgagctctggaagcgctttcatgagataggcactgagatgatcatcaccaaggccggcaggcgcatgtttccagcaatgagagtgaagatctctggattagatcctcaccagcaatattacattgccatggatattgtaccagtggacaacaaaagatacaggtatgtttaccacagttcgaaatggatggtggcaggtaatgctgactcgcctgtgccaccccgtgtgtacattcatccagactcgcctgcctcgggggagacttggatgagacaagttatcagcttcgacaagctgaagctcaccaacaatgaactggatgaccaaggccatattattcttcattctatgcacaaataccaaccgcgagtgcacgtcatccgtaaagactgtggagacgatctttctcccatcaagcctgttccatccggggagggagtaaaggcattctcctttccagaaactgtcttcacaaccgtcactgcctatcagaatcagcagattactcgcctgaagatagataggaatccatttgctaaaggcttccgagactccgggcgcaacagaatgggtttggaagccttggtggaatcatatgcattctggcgaccatcactacggactctgacctttgaagatatccctggaattcccaagcaaggcaatgcaagttcctccaccttgctccaaggtactgggaatggcgttcctgccactcaccctcaccttttgtctggctcctcttgctcctctcctgccttccatctggggcccaacaccagccagctgtgtagtctggcccctgctgactattctgcctgtgcccgctcaggcctcaccctcaaccgatacagcacatctttggcagagacctacaacaggctcaccaaccaggctggtgagacctttgccccgcccaggactccctcctatgtgggcgtgagcagcagcacctccgtgaacatgtccatgggtggcactgatggggacaccttcagctgcccacagaccagcttatccatgcagatttcgggaatgtccccccagctccagtatatcatgccatcaccctccagcaatgccttcgccactaaccagacccatcagggttcctataatacttttagattacacagcccctgtgcactatatggatataacttctccacatcccccaaactggctgccagtcctgagaaaattgtttcttcccaaggaagtttcttggggtcctcaccgagtgggaccatgacggatcggcagatgttgccccctgtggaaggagtgcacctgcttagcagtgggggtcagcagagtttctttgactctaggaccctaggaagcttaactctgtcatcatctcaagtatctgcacatatggtc

SEQ ID NO: 111 - protein, 448 aa, Homo sapiens
MAMSELGTRKPSDGTVSHLLNVVESELQAGREKGDPTEKQLQIILEDAPLWQRFKEVTNEMIVTKNGRRMFPVLKISVTGLDPNAMYSLLLDFVPTDSHRWKYVNGEWVPAGKPEVSSHSCVYIHPDSPNFGAHWMKAPISFSKVKLTNKLNGGGQIMLNSLHKYEPQVHIVRVGSAHRMVTNCSFPETQFIAVTAYQNEEITALKIKYNPFAKAFLDAKERNHLRDVPEAISESQHVTYSHLGGWIFSNPDGVCTAGNSNYQYAAPLPLPAPHTHHGCEHYSGLRGHRQAPYPSAYMHRNHSPSVNLIESSSNNLQVFSGPDSWTSLSSTPHASILSVPHTNGPINPGPSPYPCLWTISNGAGGPSGPGPEVHASTPGAFLLGNPAVTSPPSVLSTQAPTSAGVEVLGEPSLTSIAVSTWTAVASHPFAGWGGPGAGGHHSPSSLDG

SEQ ID NO: 112 - DNA, 1344 bp, Homo sapiens
atggccatgagtgagctgggcactcggaagcccagcgatggcactgtttctcatctgctcaatgtggtggagagtgagcttcaggcagggagggaaaaaggcgaccctacggagaagcaacttcagatcatcctggaggatgcacctctctggcagagattcaaggaagtcactaatgagatgattgtgaccaagaatggcagacggatgtttccagtcctaaagattagtgtcacagggttggaccccaatgccatgtactccctcctgctggactttgtccctacggacagtcaccgctggaagtacgtcaacggggaatgggtgcccgctggcaagccagaggtctccagccacagctgcgtctacattcacccggactcccccaactttggggcccactggatgaaagctcccatctccttcagcaaagtgaagctgaccaacaagctcaatggaggcgggcagataatgttgaattctctgcataaatatgaaccccaggttcacatagtgcgtgttggaagtgcccatcgaatggtaacaaactgctccttccctgaaacccagttcatagccgtgactgcctatcagaatgaggagataacggctctcaaaatcaagtacaatccttttgccaaagccttcttggatgccaaggaaagaaatcacctaagagacgtaccggaggctatctctgagagccagcatgtgacctattctcacttgggaggctggatcttttccaatccagatggagtgtgcacagcaggaaactccaattaccagtatgccgctcctctgcctctgcctgctccccacacccaccatggctgtgagcactattcgggtctccgaggacaccggcaggctccctacccttctgcgtacatgcacagaaaccattctccctcagtgaatttgatagaaagctcaagcaataatctgcaagttttctcgggacctgacagctggacttccttatcctccacaccccatgccagcatcctgtctgtaccccacaccaacggaccaatcaatccagggcccagcccctacccgtgcctgtggaccatcagcaatggtgccggaggccccagtgggccaggcccggaggtgcacgccagcaccccaggagcatttctcctcggaaacccagctgtgacttcacccccttctgtgctctccacccaagcacccacttcggctggtgtggaggttctgggggagccctcgctaaccagcattgctgtgtccacctggacagcagtggcctcgcatcccttcgcgggctggggtggcccaggagcgggtgggcaccattctccttcctcactggatggt

SEQ ID NO: 113 - protein, 297 aa, Homo sapiens
MEFTASPKPQLSSRANAFSIAALMSSGGSKEKEATENTIKPLEQFVEKSSCAQPLGELTSLDAHGEFGGGSGSSPSSSSLCTEPLIPTTPIIPSEEMAKIACSLETKELWDKFHELGTEMIITKSGRRMFPTIRVSFSGVDPEAKYIVLMDIVPVDNKRYRYAYHRSSWLVAGKADPPLPARLYVHPDSPFTGEQLLKQMVSFEKVKLTNNELDQHGHIILNSMHKYQPRVHIIKKKDHTASLLNLKSEEFRTFIFPETVFTAVTAYQNQLITKLKIDSNPFAKGFRDSSRLTDIER

SEQ ID NO: 114 - DNA, 892 bp, Homo sapiens
atggagttcacggcgtcccccaagccccaactctcctcccgggccaacgccttctccattgccgcgctcatgtcgagcggcggctctaaggagaaggaggcgacggagaacacaatcaaacccctggagcaatttgtggagaagtcgtcctgtgcccagcccctgggtgagctgaccagcctggatgctcatggggagtttggtggaggcagtggcagcagcccgtcctcctcctctctgtgcactgagccactgatccccaccacccccatcatccccagtgaggaaatggccaaaattgcctgcagcctggagaccaaggagctttgggacaaattccatgagctgggcaccgagatgatcatcaccaagtcgggcaggaggatgtttccaaccatccgggtgtccttttcgggggtggatcctgaggccaagtacatagtcctgatggacatcgtccctgtggacaacaagaggtaccgctacgcctaccaccggtcctcctggctggtggctggcaaggccgacccgccgttgccagccaggctctatgtgcatccagattctccttttaccggtgagcaactactcaaacagatggtgtcttttgaaaaggtgaaactcaccaacaatgaactggatcaacatggccatataattttgaactcaatgcataagtaccagccaagggtgcacatcattaagaagaaagaccacacagcctcattgctcaacctgaagtctgaagaatttagaactttcatctttccagaaacagtttttacggcagtcactgcctaccagaatcaactgataacgaagctgaaaatagatagcaatccttttgccaaaggattccgggattcctccaggctcactgacattgagaggt

SEQ ID NO: 115 - protein, 535 aa, Homo sapiens
MGIVEPGCGDMLTGTEPMPGSDEGRAPGADPQHRYFYPEPGAQDADERRGGGSLGSPYPGGALVPAPPSRFLGAYAYPPRPQAAGFPGAGESFPPPADAEGYQPGEGYAAPDPRAGLYPGPREDYALPAGLEVSGKLRVALNNHLLWSKFNQHQTEMIITKQGRRMFPFLSFTVAGLEPTSHYRMFVDVVLVDQHHWRYQSGKWVQCGKAEGSMPGNRLYVHPDSPNTGAHWMRQEVSFGKLKLTNNKGASNNVTQMIVLQSLHKYQPRLHIVEVNDGEPEAACNASNTHIFTFQETQFIAVTAYQNAEITQLKIDNNPFAKGFRENFESMYTSVDTSIPSPPGPNCQFLGGDHYSPLLPNQYPVPSRFYPDLPGQAKDVVPQAYWLGAPRDHSYEAEFRAVSMKPAFLPSAPGPTMSYYRGQEVLAPGAGWPVAPQYPPKMGPASWFRPMRTLPMEPGPGGSEGRGPEDQGPPLVWTEIAPIRPESSDSGLGEGDSKRRRVSPYPSSGDSSSPAGAPSPFDKEAEGQFYNYFPN

SEQ ID NO: 116 - DNA, 1605 bp, Homo sapiens
atgggcatcgtggagccgggttgcggagacatgctgacgggcaccgagccgatgccggggagcgacgagggccgggcgcctggcgccgacccgcagcaccgctacttctacccggagccgggcgcgcaggacgcggacgagcgtcgcgggggcggcagcctggggtctccctacccggggggcgccttggtgcccgccccgccgagccgcttccttggagcctacgcctacccgccgcgaccccaggcggccggcttccccggcgcgggcgagtccttcccgccgcccgcggacgccgagggctaccagccgggcgagggctacgccgccccggacccgcgcgccgggctctacccggggccgcgtgaggactacgcgctacccgcgggactggaggtgtcggggaaactgagggtcgcgctcaacaaccacctgttgtggtccaagtttaatcagcaccagacagagatgatcatcaccaagcagggacggcggatgttcccattcctgtcatttactgtggccgggctggagcccaccagccactacaggatgtttgtggacgtggtcttggtggaccagcaccactggcggtaccagagcggcaagtgggtgcagtgtggaaaggccgagggcagcatgccaggaaaccgcctgtacgtccacccggactcccccaacacaggagcgcactggatgcgccaggaagtttcatttgggaaactaaagctcacaaacaacaagggggcgtccaacaatgtgacccagatgattgtgctccagtccctccataagtaccagccccggctgcatatcgttgaggtgaacgacggagagccagaggcagcctgcaacgcttccaacacgcatatctttactttccaagaaacccagttcattgccgtgactgcctaccagaatgccgagattactcagctgaaaattgataataacccctttgccaaaggattccgggagaactttgagtccatgtacacatctgttgacaccagcatcccctccccgcctggacccaactgtcaattccttgggggagatcactactctcctctcctacccaaccagtatcctgttcccagccgcttctaccccgaccttcctggccaggcgaaggatgtggttccccaggcttactggctgggggccccccgggaccacagctatgaggctgagtttcgagcagtcagcatgaagcctgcattcttgccctctgcccctgggcccaccatgtcctactaccgaggccaggaggtcctggcacctggagctggctggcctgtggcaccccagtaccctcccaagatgggcccggccagctggttccgccctatgcggactctgcccatggaacccggccctggaggctcagagggacggggaccagaggaccagggtccccccttggtgtggactgagattgcccccatccggccggaatccagtgattcaggactgggcgaaggagactctaagaggaggcgcgtgtccccctatccttccagtggtgacagctcctcccctgctggggccccttctccttttgataaggaagctgaaggacagttttataactattttcccaac

SEQ ID NO: 117 - protein, 520 aa, Homo sapiens
MALSSRARAFSVEALVGRPSKRKLQDPIQAEQPELREKKGGEEEEERRSSAAGKSEPLEKQPKTEPSTSASSGCGSDSGYGNSSESLEEKDIQMELQGSELWKRFHDIGTEMIITKAGRRMFPSVRVKVKGLDPGKQYHVAIDVVPVDSKRYRYVYHSSQWMVAGNTDHLCIIPRFYVHPDSPCSGETWMRQIISFDRMKLTNNEMDDKGHIILQSMHKYKPRVHVIEQGSSVDLSQIQSLPTEGVKTFSFKETEFTTVTAYQNQQITKLKIERNPFAKGFRDTGRNRGVLDGLLETYPWRPSFTLDFKTFGADTQSGSSGSSPVTSSGGAPSPLNSLLSPLCFSPMFHLPTSSLGMPCPEAYLPNVNLPLCYKICPTNFWQQQPLVLPAPERLASSNSSQSLAPLMMEVPMLSSLGVTNSKSGSSEDSSDQYLQAPNSTNQMLYGLQSPGNIFLPNSITPEALSCSFHPSYDFYRYNFSMPSRLISGSNHLKVNDDSQVSFGEGKCNHVHWYPAINHYL

SEQ ID NO: 118 - DNA, 1560 bp, Homo sapiens
atggctctgagctctcgggcgcgtgccttctccgtggaagccttggtggggagacccagcaaaagaaaactccaagacccaatacaggcggagcagcctgagctgcgggagaaaaagggcggagaggaagaggaggagagaaggagcagcgctgcagggaagagcgagccgcttgaaaaacaacctaagacagagccctcaacatctgcttcctctggctgcggcagcgacagcggctacggcaacagctctgaaagtctggaagagaaagatattcaaatggagcttcaaggatctgaactgtggaaaagattccatgacatcgggactgagatgatcattactaaagcgggcaggcggatgttcccctctgttcgggtcaaggtgaaagggttggatccagggaagcagtaccatgtggccatcgatgtggtgccggtggattccaaacgctataggtacgtctatcacagctcacagtggatggtagctgggaatacagaccatttgtgcatcattcctagattctatgttcacccggactcaccctgctcgggagagacctggatgcggcagatcatcagctttgatcgcatgaaactcaccaacaatgagatggatgacaaaggccacatcattctgcaatccatgcataagtacaaaccccgagtgcacgtgatagagcaaggcagcagtgttgacctgtcccagattcagtccttgcccactgaaggtgttaaaacattctcctttaaagaaactgagttcaccacagtaacggcttaccaaaaccaacagattacgaaactaaaaatagaaagaaatccttttgctaaaggatttagagatactggaagaaacaggggtgtattggatgggcttttagagacctacccatggaggccttctttcactctcgattttaaaacctttggcgcagacacacaaagtggaagcagtggctcatctccagtgacctctagtggaggggccccctctcctttgaactccttactttctccactttgcttttcacctatgtttcatttacctacaagctcccttggaatgccctgtccagaggcatacctgcccaatgtcaacctgcctctatgctacaagatttgtccaactaatttttggcaacagcaacctcttgttttaccggctcctgaaagactagcaagcagcaacagttctcagtctttagccccactcatgatggaagtgcctatgttatcttccctgggggtcaccaattcaaaaagcggttcatctgaagactccagtgatcagtatctacaagcacctaattctaccaatcaaatgttatatggattacagtcacctggaaatatttttctgccaaactccatcaccccagaagcacttagttgctcctttcatccttcctatgacttttatagatacaatttctctatgccatctagactgataagtggttccaaccatcttaaagtgaatgacgacagtcaagtttcttttggagaaggcaaatgtaatcatgttcattggtatccagcaattaaccattacctt

SEQ ID NO: 119 - protein, 440 aa, Homo sapiens
MEQTYGEVNQLGGVFVNGRPLPNAIRLRIVELAQLGIRPCDISRQLRVSHGCVSKILARYNETGSILPGAIGGSKPRVTTPNVVKHIRDYKQGDPGIFAWEIRDRLLADGVCDKYNVPSVSSISRILRNKIGSLAQPGPYEASKQPPSQPTLPYNHIYQYPYPSPVSPTGAKMGSHPGVPGTAGHVSIPRSWPSAHSVSNILGIRTFMEQTGALAGSEGTAYSPKMEDWAGVNRTAFPATPAVNGLEKPALEADIKYTQSASTLSAVGGFLPACAYPASNQHGVYSAPGGGYLAPGPPWPPAQGPPLAPPGAGVAVHGGELAAAMTFKHPSREGSLPAPAARPRTPSVAYTDCPSRPRPPRGSSPRTRARRERQADPGAQVCAAAPAIGTGRIGGLAEEEASAGPRGARPASPQAQPCLWPDPPHFLYWSGFLGFSELGF

SEQ ID NO: 120 - DNA, 1320 bp, Homo sapiens
atggagcagacgtatggcgaggtgaaccagctgggcggtgtgttcgtcaacggccgccccctgcccaacgccatccgcttgcgcattgtggagctggcgcagctgggcatccgaccctgtgacatcagtcggcagctccgcgtatcccacggctgcgtgagcaagatcctggcgcgctacaacgagaccggctccattctgcccggggccatcggggggagcaagccccgcgtcaccactcccaacgtggtcaagcacatccgggactacaagcaaggagaccctggcatctttgcctgggagatccgcgaccggctgctggccgacggcgtctgtgacaagtacaatgtgccttcggtgagctccatcagccgcatcctgcgcaacaagatcggcagcctggcgcagcccggaccgtacgaggcaagtaagcagccgccgtcgcagcctacgctgccctacaaccacatctaccagtacccctaccccagtcccgtgtcgcccacgggcgccaagatgggcagccaccccggggtcccgggcacggcgggccacgtcagcatcccgcgctcatggccctcggcacactcggtcagcaacatcctgggcatccggacgtttatggagcaaacaggggccctggctgggagcgaaggcaccgcttactctcccaagatggaagactgggccggcgtgaaccgcacggccttccccgccacccccgcagtgaatgggctagagaaacctgccttagaggcagacattaaatacactcagtcggcctccaccctctctgccgtgggcggctttctccccgcctgcgcctacccggcctccaaccagcacggcgtgtacagcgccccgggcggcggctacctcgccccgggcccgccgtggccgcctgcgcaaggtcctcctctggcgccccccggggccggcgtagctgtgcatggcggggaactcgcggcagcaatgaccttcaagcatcccagccgagaaggaagcctcccagctccggcagcaaggccccggacgccctcagtagcttacacggactgcccatcccggcctcgacctcctaggggcagctctccccggacccgagcccggagggaacggcaggcggacccgggcgcacaggtctgcgcggcggccccggcaatcggcacgggcaggatcggaggactcgcggaggaggaagccagtgccggcccgcggggtgcacgcccagccagcccccaggcccagccctgcctctggccggacccaccacacttcctttattggtctgggtttttaggcttctctgaacttgggttt

SEQ ID NO: 121 - protein, 204 aa, Homo sapiens
MQSYASAMLSVFNSDDYSPAVQENIPALRRSSSFLCTESCNSKYQCETGENSKGNVQDRVKRPMNAFIVWSRDQRRKMALENPRMRNSEISKQLGYQWKMLTEAEKWPFFQEAQKLQAMHREKYPNYKYRPRRKAKMLPKNCSLLPADPASVLCSEVQLDNRLYRDDCTKATHSRMEHQLGHLPPINAASSPQQRDRYSHWTKL

SEQ ID NO: 122 - DNA, 612 bp, Homo sapiens
atgcaatcatatgcttctgctatgttaagcgtattcaacagcgatgattacagtccagctgtgcaagagaatattcccgctctccggagaagctcttccttcctttgcactgaaagctgtaactctaagtatcagtgtgaaacgggagaaaacagtaaaggcaacgtccaggatagagtgaagcgacccatgaacgcattcatcgtgtggtctcgcgatcagaggcgcaagatggctctagagaatcccagaatgcgaaactcagagatcagcaagcagctgggataccagtggaaaatgcttactgaagccgaaaaatggccattcttccaggaggcacagaaattacaggccatgcacagagagaaatacccgaattataagtatcgacctcgtcggaaggcgaagatgctgccgaagaattgcagtttgcttcccgcagatcccgcttcggtactctgcagcgaagtgcaactggacaacaggttgtacagggatgactgtacgaaagccacacactcaagaatggagcaccagctaggccacttaccgcccatcaacgcagccagctcaccgcagcaacgggaccgctacagccactggacaaagctg

SEQ ID NO: 123 - protein, 391 aa, Homo sapiens
MYSMMMETDLHSPGGAQAPTNLSGPAGAGGGGGGGGGGGGGGGAKANQDRVKRPMNAFMVWSRGQRRKMAQENPKMHNSEISKRLGAEWKVMSEAEKRPFIDEAKRLRALHMKEHPDYKYRPRRKTKTLLKKDKYSLAGGLLAAGAGGGGAAVAMGVGVGVGAAAVGQRLESPGGAAGGGYAHVNGWANGAYPGSVAAAAAAAAMMQEAQLAYGQHPGAGGAHPHAHPAHPHPHHPHAHPHNPQPMHRYDMGALQYSPISNSQGYMSASPSGYGGLPYGAAAAAAAAAGGAHQNSAVAAAAAAAAASSGALGALGSLVKSEPSGSPPAPAHSRAPCPGDLREMISMYLPAGEGGDPAAAAAAAAQSRLHSLPQHYQGAGAGVNGTVPLTHI

SEQ ID NO: 124 - DNA, 1173 bp, Homo sapiens
atgtacagcatgatgatggagaccgacctgcactcgcccggcggcgcccaggcccccacgaacctctcgggccccgccggggcgggcggcggcgggggcggaggcgggggcggcggcggcggcgggggcgccaaggccaaccaggaccgggtcaaacggcccatgaacgccttcatggtgtggtcccgcgggcagcggcgcaagatggcccaggagaaccccaagatgcacaactcggagatcagcaagcgcctgggggccgagtggaaggtcatgtccgaggccgagaagcggccgttcatcgacgaggccaagcggctgcgcgcgctgcacatgaaggagcacccggattacaagtaccggccgcgccgcaagaccaagacgctgctcaagaaggacaagtactcgctggccggcgggctcctggcggccggcgcgggtggcggcggcgcggctgtggccatgggcgtgggcgtgggcgtgggcgcggcggccgtgggccagcgcctggagagcccaggcggcgcggcgggcggcggctacgcgcacgtcaacggctgggccaacggcgcctaccccggctcggtggcggcggcggcggcggccgcggccatgatgcaggaggcgcagctggcctacgggcagcacccgggcgcgggcggcgcgcacccgcacgcgcaccccgcgcacccgcacccgcaccacccgcacgcgcacccgcacaacccgcagcccatgcaccgctacgacatgggcgcgctgcagtacagccccatctccaactcgcagggctacatgagcgcgtcgccctcgggctacggcggcctcccctacggcgccgcggccgccgccgccgccgctgcgggcggcgcgcaccagaactcggccgtggcggcggcggcggcggcggcggccgcgtcgtcgggcgccctgggcgcgctgggctctctggtgaagtcggagcccagcggcagcccgcccgccccagcgcactcgcgggcgccgtgccccggggacctgcgcgagatgatcagcatgtacttgcccgccggcgaggggggcgacccggcggcggcagcagcggccgcggcgcagagccggctgcactcgctgccgcagcactaccagggcgcgggcgcgggcgtgaacggcacggtgcccctgacgcacatc

SEQ ID NO: 125 - protein, 317 aa, Homo sapiens
MYNMMETELKPPGPQQTSGGGGGNSTAAAAGGNQKNSPDRVKRPMNAFMVWSRGQRRKMAQENPKMHNSEISKRLGAEWKLLSETEKRPFIDEAKRLRALHMKEHPDYKYRPRRKTKTLMKKDKYTLPGGLLAPGGNSMASGVGVGAGLGAGVNQRMDSYAHMNGWSNGSYSMMQDQLGYPQHPGLNAHGAAQMQPMHRYDVSALQYNSMTSSQTYMNGSPTYSMSYSQQGTPGMALGSMGSVVKSEASSSPPVVTSSSHSRAPCQAGDLRDMISMYLPGAEVPEPAAPSRLHMSQHYQSGPVPGTAINGTLPLSHM

SEQ ID NO: 126 - DNA, 951 bp, Homo sapiens
atgtacaacatgatggagacggagctgaagccgccgggcccgcagcaaacttcggggggcggcggcggcaactccaccgcggcggcggccggcggcaaccagaaaaacagcccggaccgcgtcaagcggcccatgaatgccttcatggtgtggtcccgcgggcagcggcgcaagatggcccaggagaaccccaagatgcacaactcggagatcagcaagcgcctgggcgccgagtggaaacttttgtcggagacggagaagcggccgttcatcgacgaggctaagcggctgcgagcgctgcacatgaaggagcacccggattataaataccggccccggcggaaaaccaagacgctcatgaagaaggataagtacacgctgcccggcgggctgctggcccccggcggcaatagcatggcgagcggggtcggggtgggcgccggcctgggcgcgggcgtgaaccagcgcatggacagttacgcgcacatgaacggctggagcaacggcagctacagcatgatgcaggaccagctgggctacccgcagcacccgggcctcaatgcgcacggcgcagcgcagatgcagcccatgcaccgctacgacgtgagcgccctgcagtacaactccatgaccagctcgcagacctacatgaacggctcgcccacctacagcatgtcctactcgcagcagggcacccctggcatggctcttggctccatgggttcggtggtcaagtccgaggccagctccagcccccctgtggttacctcttcctcccactccagggcgccctgccaggccggggacctccgggacatgatcagcatgtatctccccggcgccgaggtgccggaacccgccgcccccagcagacttcacatgtcccagcactaccagagcggcccggtgcccggcacggccattaacggcacactgcccctctcacacatg

SEQ ID NO: 127 - protein, 446 aa, Homo sapiens
MRPVRENSSGARSPRVPADLARSILISLPFPPDSLAHRPPSSAPTESQGLFTVAAPAPGAPSPPATLAHLLPAPAMYSLLETELKNPVGTPTQAAGTGGPAAPGGAGKSSANAAGGANSGGGSSGGASGGGGGTDQDRVKRPMNAFMVWSRGQRRKMALENPKMHNSEISKRLGADWKLLTDAEKRPFIDEAKRLRAVHMKEYPDYKYRPRRKTKTLLKKDKYSLPSGLLPPGAAAAAAAAAAAAAAASSPVGVGQRLDTYTHVNGWANGAYSLVQEQLGYAQPPSMSSPPPPPALPPMHRYDMAGLQYSPMMPPGAQSYMNVAAAAAAASGYGGMAPSATAAAAAAYGQQPATAAAAAAAAAAMSLGPMGSVVKSEPSSPPPAIASHSQRACLGDLRDMISMYLPPGGDAADAASPLPGGRLHGVHQHYQGAGTAVNGTVPLTHI

SEQ ID NO: 128 - DNA, 1338 bp, Homo sapiens
atgcgacctgttcgagagaactcatcaggtgcgagaagcccgcgggttcctgctgatttggcgcggagcattttgataagcctacccttcccgccggactcgctggcccacaggcccccaagctccgctccgacggagtcccagggccttttcaccgtggccgctccagccccgggagcgccttctcctcccgccacgctggcgcaccttcttcccgccccggcaatgtacagccttctggagactgaactcaagaaccccgtagggacacccacacaagcggcgggcaccggcggccccgcagccccgggaggcgcaggcaagagtagtgcgaacgcagccggcggcgcgaactcgggcggcggcagcagcggtggtgcgagcggaggtggcgggggtacagaccaggaccgtgtgaaacggcccatgaacgccttcatggtatggtcccgcgggcagcggcgcaaaatggccctggagaaccccaagatgcacaattctgagatcagcaagcgcttgggcgccgactggaaactgctgaccgacgccgagaagcgaccattcatcgacgaggccaagcgacttcgcgccgtgcacatgaaggagtatccggactacaagtaccgaccgcgccgcaagaccaagacgctgctcaagaaagataagtactccctgcccagcggcctcctgcctcccggtgccgcggccgccgccgccgctgccgcggccgcagccgctgccgccagcagtccggtgggcgtgggccagcgcctggacacgtacacgcacgtgaacggctgggccaacggcgcgtactcgctggtgcaggagcagctgggctacgcgcagcccccgagcatgagcagcccgccgccgccgcccgcgctgccgccgatgcaccgctacgacatggccggcctgcagtacagcccaatgatgccgcccggcgctcagagctacatgaacgtcgctgccgcggccgccgccgcctcgggctacgggggcatggcgccctcagccacagcagccgcggccgccgcctacgggcagcagcccgccaccgccgcggccgcagctgcggccgcagccgccatgagcctgggccccatgggctcggtagtgaagtctgagcccagctcgccgccgcccgccatcgcatcgcactctcagcgcgcgtgcctcggcgacctgcgcgacatgatcagcatgtacctgccacccggcggggacgcggccgacgccgcctctccgctgcccggcggtcgcctgcacggcgtgcaccagcactaccagggcgccgggactgcagtcaacggaacggtgccgctgacccacatc

SEQ ID NO: 129 - protein, 240 aa, Homo sapiens
MSKPSDHIKRPMNAFMVWSRGQRRKMAQENPKMHNSEISKRLGAEWKLLSEAEKRPYIDEAKRLRAQHMKEHPDYKYRPRRKPKNLLKKDRYVFPLPYLGDTDPLKAAGLPVGASDGLLSAPEKARAFLPPASAPYSLLDPAQFSSSAIQKMGEVPHTLATGALPYASTLGYQNGAFGSLSCPSQHTHTHPSPTNPGYVVPCNCTAWSASTLQPPVAYILFPGMTKTGIDPYSSAHATAM

SEQ ID NO: 130 - DNA, 720 bp, Homo sapiens
atgtccaaaccttcagaccacatcaagcggcccatgaacgccttcatggtatggtcccggggccagcggcgcaagatggcccaggaaaaccccaagatgcacaactcggagatcagcaaacgcctaggtgccgaatggaagcttctgtccgaggcagagaagcggccatacatcgatgaagccaagcggctacgcgcccagcacatgaaggagcaccctgactacaagtaccgacctcggcgcaagcccaagaacctgctcaagaaggacaggtatgtcttccccttgccctacctgggcgacacggacccgctcaaggcggctggcctgcccgtgggggcctccgacggcctcctgagcgcgcccgagaaagcccgggccttcttgccgccggcctcggcgccctactccctgctggaccccgcgcagtttagctcgagcgccatccagaagatgggcgaagtgccccacaccttggctaccggcgctctgccctacgcgtccaccctgggctaccagaacggcgccttcggcagcctcagctgccccagccagcacacgcacacgcacccgtcccccaccaaccctggctacgtggtgccctgtaactgtaccgcctggtctgcctccaccctgcagccccccgtcgcctacatcctcttcccaggcatgaccaagactggcatagacccttattcgtcagcccacgctacggccatg

SEQ ID NO: 131 - protein, 276 aa, Homo sapiens
MSKPVDHVKRPMNAFMVWSRAQRRKMAQENPKMHNSEISKRLGAEWKLLTESEKRPFIDEAKRLRAMHMKEHPDYKYRPRRKPKTLLKKDKFAFPVPYGLGGVADAEHPALKAGAGLHAGAGGGLVPESLLANPEKAAAAAAAAAARVFFPQSAAAAAAAAAAAAAGSPYSLLDLGSKMAEISSSSSGLPYASSLGYPTAGAGAFHGAAAAAAAAAAAAGGHTHSHPSPGNPGYMIPCNCSAWPSPGLQPPLAYILLPGMGKPQLDPYPAAYAAAL

SEQ ID NO: 132 - DNA, 828 bp, Homo sapiens
atgtccaagccggtggaccacgtcaagcggcccatgaacgccttcatggtgtggtcgcgggctcagcggcgcaagatggcccaggagaaccccaagatgcacaactcggagatcagcaagcgcttgggcgccgagtggaaactgctcacagagtcggagaagcggccgttcatcgacgaggccaagcgtctacgcgccatgcacatgaaggagcaccccgactacaagtaccggccgcggcgcaagcccaagacgctgctcaagaaggacaagttcgccttcccggtgccctacggcctgggcggcgtggcggacgccgagcaccctgcgctcaaggcgggcgccgggctgcacgcgggggcgggcggcggcctggtgcctgagtcgctgctcgccaatcccgagaaggcggccgcggccgccgccgctgccgccgcacgcgtcttcttcccgcagtcggccgctgccgccgccgctgccgccgccgccgccgccgcgggcagcccctactcgctgctcgacctgggctccaaaatggcagagatctcgtcgtcctcgtccggcctcccgtacgcgtcgtcgctgggctacccgaccgcgggcgcgggcgccttccacggcgcggcggcggcggctgcagcggcggccgccgccgccggggggcacacgcactcgcaccccagcccgggcaacccgggctacatgatcccgtgcaactgcagcgcgtggcccagccccgggctgcagccgccgctcgcctacatcctgctgccgggcatgggcaagccccagctggacccctaccccgcggcctacgctgccgcgcta

SEQ ID NO: 133 - protein, 474 aa, Homo sapiens
MVQQTNNAENTEALLAGESSDSGAGLELGIASSPTPGSTASTGGKADDPSWCKTPSGHIKRPMNAFMVWSQIERRKIMEQSPDMHNAEISKRLGKRWKLLKDSDKIPFIREAERLRLKHMADYPDYKYRPRKKVKSGNANSSSSAAASSKPGEKGDKVGGSGGGGHGGGGGGGSSNAGGGGGGASGGGANSKPAQKKSCGSKVAGGAGGGVSKPHAKLILAGGGGGGKAAAAAAASFAAEQAGAAALLPLGAAADHHSLYKARTPSASASASSAASASAALAAPGKHLAEKKVKRVYLFGGLGTSSSPVGGVGAGADPSDPLGLYEEEGAGCSPDAPSLSGRSSAASSPAAGRSPADHRGYASLRAASPAPSSAPSHASSSASSHSSSSSSSGSSSSDDEFEDDLLDLNPSSNFESMSLGSFSSSSALDRDLDFNFEPGSGSHFEFPDYCTPEVSEMISGDWLESSISNLVFTY

SEQ ID NO: 134 - DNA, 1422 bp, Homo sapiens
atggtgcagcaaaccaacaatgccgagaacacggaagcgctgctggccggcgagagctcggactcgggcgccggcctcgagctgggaatcgcctcctcccccacgcccggctccaccgcctccacgggcggcaaggccgacgacccgagctggtgcaagaccccgagtgggcacatcaagcgacccatgaacgccttcatggtgtggtcgcagatcgagcggcgcaagatcatggagcagtcgcccgacatgcacaacgccgagatctccaagcggctgggcaaacgctggaagctgctcaaagacagcgacaagatccctttcattcgagaggcggagcggctgcgcctcaagcacatggctgactaccccgactacaagtaccggcccaggaagaaggtgaagtccggcaacgccaactccagctcctcggccgccgcctcctccaagccgggggagaagggagacaaggtcggtggcagtggcgggggcggccatgggggcggcggcggcggcgggagcagcaacgcggggggaggaggcggcggtgcgagtggcggcggcgccaactccaaaccggcgcagaaaaagagctgcggctccaaagtggcgggcggcgcgggcggtggggttagcaaaccgcacgccaagctcatcctggcaggcggcggcggcggcgggaaagcagcggctgccgccgccgcctccttcgccgccgaacaggcgggggccgccgccctgctgcccctgggcgccgccgccgaccaccactcgctgtacaaggcgcggactcccagcgcctcggcctccgcctcctcggcagcctcggcctccgcagcgctcgcggccccgggcaagcacctggcggagaagaaggtgaagcgcgtctacctgttcggcggcctgggcacgtcgtcgtcgcccgtgggcggcgtgggcgcgggagccgaccccagcgaccccctgggcctgtacgaggaggagggcgcgggctgctcgcccgacgcgcccagcctgagcggccgcagcagcgccgcctcgtcccccgccgccggccgctcgcccgccgaccaccgcggctacgccagcctgcgcgccgcctcgcccgccccgtccagcgcgccctcgcacgcgtcctcctcggcctcgtcccactcctcctcttcctcctcctcgggctcctcgtcctccgacgacgagttcgaagacgacctgctcgacctgaaccccagctcaaactttgagagcatgtccctgggcagcttcagttcgtcgtcggcgctcgaccgggacctggattttaacttcgagcccggctccggctcgcacttcgagttcccggactactgcacgcccgaggtgagcgagatgatctcgggagactggctcgagtccagcatctccaacctggttttcacctac

SEQ ID NO: 135 - protein, 441 aa, Homo sapiens
MVQQAESLEAESNLPREALDTEEGEFMACSPVALDESDPDWCKTASGHIKRPMNAFMVWSKIERRKIMEQSPDMHNAEISKRLGKRWKMLKDSEKIPFIREAERLRLKHMADYPDYKYRPRKKPKMDPSAKPSASQSPEKSAAGGGGGSAGGGAGGAKTSKGSSKKCGKLKAPAAAGAKAGAGKAAQSGDYGGAGDDYVLGSLRVSGSGGGGAGKTVKCVFLDEDDDDDDDDDELQLQIKQEPDEEDEEPPHQQLLQPPGQQPSQLLRRYNVAKVPASPTLSSSAESPEGASLYDEVRAGATSGAGGGSRLYYSFKNITKQHPPPLAQPALSPASSRSVSTSSSSSSGSSSGSSGEDADDLMFDLSLNFSQSAHSASEQQLGGGAAAGNLSLSLVDKDLDSFSEGSLGSHFEFPDYCTPELSEMIAGDWLEANFSDLVFTY

SEQ ID NO: 136 - DNA, 1323 bp, Homo sapiens
atggtgcagcaggcggagagcttggaagcggagagcaacctgccccgggaggcgctggacacggaggagggcgaattcatggcttgcagcccggtggccctggacgagagcgacccagactggtgcaagacggcgtcgggccacatcaagcggccgatgaacgcgttcatggtatggtccaagatcgaacgcaggaagatcatggagcagtctccggacatgcacaacgccgagatctccaagaggctgggcaagcgctggaaaatgctgaaggacagcgagaagatcccgttcatccgggaggcggagcggctgcggctcaagcacatggccgactaccccgactacaagtaccggccccggaaaaagcccaaaatggacccctcggccaagcccagcgccagccagagcccagagaagagcgcggccggcggcggcggcgggagcgcgggcggaggcgcgggcggtgccaagacctccaagggctccagcaagaaatgcggcaagctcaaggcccccgcggccgcgggcgccaaggcgggcgcgggcaaggcggcccagtccggggactacgggggcgcgggcgacgactacgtgctgggcagcctgcgcgtgagcggctcgggcggcggcggcgcgggcaagacggtcaagtgcgtgtttctggatgaggacgacgacgacgacgacgacgacgacgagctgcagctgcagatcaaacaggagccggacgaggaggacgaggaaccaccgcaccagcagctcctgcagccgccggggcagcagccgtcgcagctgctgagacgctacaacgtcgccaaagtgcccgccagccctacgctgagcagctcggcggagtcccccgagggagcgagcctctacgacgaggtgcgggccggcgcgacctcgggcgccgggggcggcagccgcctctactacagcttcaagaacatcaccaagcagcacccgccgccgctcgcgcagcccgcgctgtcgcccgcgtcctcgcgctcggtgtccacctcctcgtccagcagcagcggcagcagcagcggcagcagcggcgaggacgccgacgacctgatgttcgacctgagcttgaatttctctcaaagcgcgcacagcgccagcgagcagcagctggggggcggcgcggcggccgggaacctgtccctgtcgctggtggataaggatttggattcgttcagcgagggcagcctgggctcccacttcgagttccccgactactgcacgccggagctgagcgagatgatcgcgggggactggctggaggcgaacttctccgacctggtgttcacatat

SEQ ID NO: 137 - protein, 315 aa, Homo sapiens
MVQQRGARAKRDGGPPPPGPGPAEEGAREPGWCKTPSGHIKRPMNAFMVWSQHERRKIMDQWPDMHNAEISKRLGRRWQLLQDSEKIPFVREAERLRLKHMADYPDYKYRPRKKSKGAPAKARPRPPGGSGGGSRLKPGPQLPGRGGRRAAGGPLGGGAAAPEDDDEDDDEELLEVRLVETPGRELWRMVPAGRAARGQAERAQGPSGEGAAAAAAASPTPSEDEEPEEEEEEAAAAEEGEEETVASGEESLGFLSRLPPGPAGLDCSALDRDPDLQPPSGTSHFEFPDYCTPEVTEMIAGDWRPSSIADLVFTY

SEQ ID NO: 138 - DNA, 945 bp, Homo sapiens
atggtgcagcagcggggcgcgagggccaagcgggacggcgggccgccgcccccgggacccgggccggccgaggagggggcgcgcgagcccggctggtgcaagaccccgagcggccacatcaagaggccgatgaacgcattcatggtgtggtcgcagcacgaacggcggaagatcatggaccagtggcccgacatgcacaacgccgagatctccaagcgcctgggccgccgctggcagctgctgcaggactcggagaagatcccgttcgtgcgggaggcggagcggctgcggctcaagcacatggcggattacccggactacaagtaccggccgcgcaaaaagagcaagggggcgcccgccaaggcgcggccccgcccccccggtggtagcggtggcggcagccggctcaagcccgggccgcagctgcctggccgcgggggccgccgagcagcgggagggcctttggggggcggggcggcggcgcccgaggacgacgatgaagacgacgacgaggagctgctggaagtgcgcctggtcgagaccccggggcgggagctgtggaggatggtcccggcgggacgggccgctcggggacaagcggagcgcgcccaagggccgtcgggcgagggggcggccgccgccgccgccgcctccccgacaccgtcggaggacgaggagccggaggaagaggaggaggaggcggcagcggctgaggaaggtgaagaggagacggtggcgtcgggggaggagtcgctgggctttctgtccaggctgccccctggcccggccggcctggactgcagcgccctggatcgcgacccggacctgcagcctccctcgggcacgtcgcacttcgagttcccggactactgcacccccgaggttaccgagatgatcgcgggggactggcgcccgtctagcatcgcagacctggttttcacctac

SEQ ID NO: 139 - protein, 763 aa, Homo sapiens [sequence omitted]

SEQ ID NO: 140 - DNA, 2289 bp, Homo sapiens
atgcttactgaccctgatttacctcaggagtttgaaaggatgtcttccaagcgaccagcctctccgtatggggaagcagatggagaggtagccatggtgacaagcagacagaaagtggaagaagaggagagtgacgggctcccagcctttcaccttcccttgcatgtgagttttcccaacaagcctcactctgaggaatttcagccagtttctctgctgacgcaagagacttgtggccataggactcccacttctcagcacaatacaatggaagttgatggcaataaagttatgtcttcatttgccccacacaactcatctacctcacctcagaaggcagaagaaggtgggcgacagagtggcgagtccttgtctagtacagccctgggaactcctgaacggcgcaagggcagtttagctgatgttgttgacaccttgaagcagaggaaaatggaagagctcatcaaaaacgagccggaagaaacccccagtattgaaaaactactctcaaaggactggaaagacaagcttcttgcaatgggatcggggaactttggcgaaataaaagggactcccgagagcttagctgagaaagaaaggcaactcatgggtatgatcaaccagctgaccagcctccgagagcagctgttggctgcccacgatgagcagaagaaactagctgcctctcagattgagaaacagcgtcagcaaatggagctggccaagcagcaacaagaacaaattgcaagacagcagcagcagcttctacagcaacaacacaaaatcaatttgctccagcaacagatccaggttcaaggtcagctgccgccattaatgattcccgtattccctcctgatcaacggacactggctgcagctgcccagcaaggattcctcctccctccaggcttcagctataaggctggatgtagtgacccttaccctgttcagctgatcccaactaccatggcagctgctgccgcagcaacaccaggcttaggcccactccaactgcagcagttatatgctgcccagctagctgcaatgcaggtatctccaggagggaagctgccaggcataccccaaggcaaccttggtgctgctgtatctcctaccagcattcacacagacaagagcacaaacagcccaccacccaaaagcaaggatgaagtggcacagccactgaacctatcagctaaacccaagacctctgatggcaaatcacccacatcacccacctctccccatatgccagctctgagaataaacagtggggcaggccccctcaaagcctctgtcccagcagcgttagctagtccttcagccagagttagcacaataggttacttaaatgaccatgatgctgtcaccaaggcaatccaagaagctcggcaaatgaaggagcaactccgacgggaacaacaggtgcttgatgggaaggtggctgttgtgaatagtctgggtctcaataactgccgaacagaaaaggaaaaaacaacactggagagtctgactcagcaactggcagttaaacagaatgaagaaggaaaatttagccatgcaatgatggatttcaatctgagtggagattctgatggaagtgctggagtctcagagtcaagaatttatagggaatcccgagggcgtggtagcaatgaaccccacataaagcgtccaatgaatgccttcatggtgtgggctaaagatgaacggagaaagatccttcaagcctttcctgacatgcacaactccaacatcagcaagatattgggatctcgctggaaagctatgacaaacctagagaaacagccatattatgaggagcaagcccgtctcagcaagcagcacctggagaagtaccctgactataagtacaagcccaggccaaagcgcacctgcctggtggatggcaaaaagctgcgcattggtgaatacaaggcaatcatgcgcaacaggcggcaggaaatgcggcagtacttcaatgttgggcaacaagcacagatccccattgccactgctggtgttgtgtaccctggagccatcgccatggctgggatgccctcccctcacctgccctcggagcactcaagcgtgtctagcagcccagagcctgggatgcctgttatccagagcacttacggtgtgaaaggagaggagccacatatcaaagaagagatacaggccgaggacatcaatggagaaatttatgatgagtacgacgaggaagaggatgatccagatgtagattatgggagtgacagtgaaaaccatattgcaggacaagccaac

SEQ ID NO: 141 - protein, 804 aa, Homo sapiens
MGRMSSKQATSPFACAADGEDAMTQDLTSREKEEGSDQHVASHLPLHPIMHNKPHSEELPTLVSTIQQDADWDSVLSSQQRMESENNKLCSLYSFRNTSTSPHKPDEGSRDREIMTSVTFGTPERRKGSLADVVDTLKQKKLEEMTRTEQEDSSCMEKLLSKDWKEKMERLNTSELLGEIKGTPESLAEKERQLSTMITQLISLREQLLAAHDEQKKLAASQIEKQRQQMDLARQQQEQIARQQQQLLQQQHKINLLQQQIQVQGHMPPLMIPIFPHDQRTLAAAAAAQQGFLFPPGITYKPGDNYPVQFIPSTMAAAAASGLSPLQLQQLYAAQLASMQVSPGAKMPSTPQPPNTAGTVSPTGIKNEKRGTSPVTQVKDEAAAQPLNLSSRPKTAEPVKSPTSPTQNLFPASKTSPVNLPNKSSIPSPIGGSLGRGSSLGKWKSQHQEETYELDILSSLNSPALFGDQDTVMKAIQEARKMREQIQREQQQQQPHGVDGKLSSINNMGLNSCRNEKERTRFENLGPQLTGKSNEDGKLGPGVIDLTRPEDAEGSKAMNGSAAKLQQYYCWPTGGATVAEARVYRDARGRASSEPHIKRPMNAFMVWAKDERRKILQAFPDMHNSNISKILGSRWKSMSNQEKQPYYEEQARLSKIHLEKYPNYKYKPRPKRTCIVDGKKLRIGEYKQLMRSRRQEMRQFFTVGQQPQIPITTGTGVVYPGAITMATTTPSPQMTSDCSSTSASPEPSLPVIQSTYGMKTDGGSLAGNEMINGEDEMEMYDDYEDDPKSDYSSENEAPEAVSAN

SEQ ID NO: 142 - DNA, 2412 bp, Homo sapiens
atgggaagaatgtcttccaagcaagccacctctccatttgcctgtgcagctgatggagaggatgcaatgacccaggatttaacctcaagggaaaaggaagagggcagtgatcaacatgtggcctcccatctgcctctgcaccccataatgcacaacaaacctcactctgaggagctaccaacacttgtcagtaccattcaacaagatgctgactgggacagcgttctgtcatctcagcaaagaatggaatcagagaataataagttatgttccctatattccttccgaaatacctctacctcaccacataagcctgacgaagggagtcgggaccgtgagataatgaccagtgttacttttggaaccccagagcgccgcaaagggagtcttgccgatgtggtggacacactgaaacagaagaagcttgaggaaatgactcggactgaacaagaggattcctcctgcatggaaaaactactttcaaaagattggaaggaaaaaatggaaagactaaataccagtgaacttcttggagaaattaaaggtacacctgagagcctggcagaaaaagaacggcagctctccaccatgattacccagctgatcagtttacgggagcagctactggcagcgcatgatgaacagaaaaaactggcagcgtcacaaattgagaaacaacggcagcaaatggaccttgctcgccaacagcaagaacagattgcgagacaacagcagcaacttctgcaacagcagcacaaaattaatctcctgcagcaacagatccaggttcagggtcacatgcctccgctcatgatcccaatttttccacatgaccagcggactctggcagcagctgctgctgcccaacagggattcctcttcccccctggaataacatacaaaccaggtgataactaccccgtacagttcattccatcaacaatggcagctgctgctgcttctggactcagccctttacagctccagcagctctatgccgctcagctggccagcatgcaggtgtcacctggagcaaagatgccatcaactccacagccaccaaacacagcagggacggtctcacctactgggataaaaaatgaaaagagagggaccagccctgtaactcaagttaaggatgaagcagcagcacagcctctgaatctctcatcccgacccaagacagcagagcctgtaaagtccccaacgtctcccacccagaacctcttcccagccagcaaaaccagccctgtcaatctgccaaacaaaagcagcatccctagccccattggaggaagcctgggaagaggatcctctttaggtaaatggaaaagtcaacaccaggaagagacttacgaattagatatcctatctagtctcaactcccctgccctttttggggatcaggatacagtgatgaaagccattcaggaggcgcggaagatgcgagagcagatccagcgggagcaacagcagcaacagccacatggtgttgacgggaaactgtcctccataaataatatggggctgaacagctgcaggaatgaaaaggaaagaacgcgctttgagaatttggggccccagttaacgggaaagtcaaatgaagatggaaaactgggcccaggtgtcatcgaccttactcggccagaagatgcagagggaagtaaagcaatgaatggctctgcagctaaactacagcagtattattgttggccaacaggaggtgccactgtggctgaagcacgagtctacagggacgcccgcggccgtgccagcagcgagccacacattaagcgaccaatgaatgcattcatggtttgggcaaaggatgagaggagaaaaatccttcaggccttccccgacatgcataactccaacattagcaaaatcttaggatctcgctggaaatcaatgtccaaccaggagaagcaaccttattatgaagagcaggcccggctaagcaagatccacttagagaagtacccaaactataaatacaaaccccgaccgaaacgcacctgcattgttgatggcaaaaagcttcggattggggagtataagcaactgatgaggtctcggagacaggagatgaggcagttctttactgtggggcaacagcctcagattccaatcaccacaggaacaggtgttgtgtatcctggtgctatcactatggcaactaccacaccatcgcctcagatgacatctgactgctctagcacctcggccagcccggagcccagcctcccggtcatccagagcacttatggtatgaagacagatggcggaagcctagctggaaatgaaatgatcaatggagaggatgaaatggaaatgtatgatgactatgaagatgaccccaaatcagactatagcagtgaaaatgaagccccggaggctgtcagtgccaac

SEQ ID NO: 143 - protein, 622 aa, Homo sapiens
MSMRSPISAQLALDGVGTMVNCTIKSEEKKEPCHEAPQGSATAAEPQPGDPARASQDSADPQAPAQGNFRGSWDCSSPEGNGSPEPKRPGVSEAASGSQEKLDFNRNLKEVVPAIEKLLSSDWKERFLGRNSMEAKDVKGTQESLAEKELQLLVMIHQLSTLRDQLLTAHSEQKNMAAMLFEKQQQQMELARQQQEQIAKQQQQLIQQQHKINLLQQQIQQVNMPYVMIPAFPPSHQPLPVTPDSQLALPIQPIPCKPVEYPLQLLHSPPAPVVKRPGAMATHHPLQEPSQPLNLTAKPKAPELPNTSSSPSLKMSSCVPRPPSHGGPTRDLQSSPPSLPLGFLGEGDAVTKAIQDARQLLHSHSGALDGSPNTPFRKDLISLDSSPAKERLEDGCVHPLEEAMLSCDMDGSRHFPESRNSSHIKRPMNAFMVWAKDERRKILQAFPDMHNSSISKILGSRWKSMTNQEKQPYYEEQARLSRQHLEKYPDYKYKPRPKRTCIVEGKRLRVGEYKALMRTRRQDARQSYVIPPQAGQVQMSSSDVLYPRAAGMPLAQPLVEHYVPRSLDPNMPVIVNTCSLREEGEGTDDRHSVADGEMYRYSEDEDSEGEEKSDGELVVLTD

SEQ ID NO: 144 - DNA, 1866 bp, Homo sapiens
atgtccatgaggagccccatctctgcccagctggccctggatggcgttggcaccatggtgaactgcaccatcaagtcagaggagaagaaagagccttgccacgaggccccccagggctcagccactgccgctgaacctcagcctggagacccagcccgggcctcccaggatagtgctgacccccaagctccagcccaggggaatttcaggggctcctgggactgtagctctccagagggtaatgggtccccagaacccaagagaccaggagtgtcggaggctgcctctggaagccaggagaagctggacttcaaccgaaatttgaaagaagtggtgccagccatagagaagctgttgtccagtgactggaaggagaggtttctaggaaggaactctatggaagccaaagatgtcaaagggacccaagagagcctagcagagaaggagctccagcttctggtcatgattcaccagctgtccaccctgcgggaccagctcctgacagcccactcggagcagaagaacatggctgccatgctgtttgagaagcagcagcagcagatggagcttgcccggcagcagcaggagcagattgcaaagcagcagcagcagctgattcagcagcagcataagatcaacctccttcagcagcagatccagcaggttaacatgccttatgtcatgatcccagccttccccccaagccaccaacctctgcctgtcacccctgactcccagctggccttacccattcagcccattccctgcaaaccagtggagtatccgctgcagctgctgcacagcccccctgccccagtggtgaagaggcctggggccatggccacccaccaccccctgcaggagccctcccagcccctgaacctcacagccaagcccaaggcccccgagctgcccaacacctccagctccccaagcctgaagatgagcagctgtgtgccccgcccccccagccatggaggccccacgcgggacctgcagtccagccccccgagcctgcctctgggcttccttggtgaaggggacgctgtcaccaaagccatccaggatgctcggcagctgctgcacagccacagtggggccttggatggctcccccaacacccccttccgtaaggacctcatcagcctggactcatccccagccaaggagcggctggaggacggctgtgtgcacccactggaggaagccatgctgagctgcgacatggatggctcccgccacttccccgagtcccgaaacagcagccacatcaagaggcccatgaacgccttcatggtgtgggccaaggatgagcggaggaagatcctgcaagccttcccagacatgcacaactccagcatcagcaagatccttggatctcgctggaagtccatgaccaaccaggagaagcagccctactatgaggaacaggcgcggctgagccggcagcacctggagaagtatcctgactacaagtacaagccgcggcccaagcgcacctgcatcgtggagggcaagcggctgcgcgtgggagagtacaaggccctgatgaggacccggcgtcaggatgcccgccagagctacgtgatccccccgcaggctggccaggtgcagatgagctcctcagatgtcctgtaccctcgggcagcaggcatgccgctggcacagccactggtggagcactatgtccctcgtagcctggaccccaacatgcctgtgatcgtcaacacctgcagcctcagagaggagggtgagggcacagatgacaggcactcggtggctgatggcgagatgtaccggtacagcgaggacgaggactcggagggcgaagagaagagcgatggggagttggtggtgctcacagac

SEQ ID NO: 145 - protein, 446 aa, Homo sapiens [sequence omitted]

SEQ ID NO: 146 - DNA, 1338 bp, Homo sapiens
atgctggacatgagcgaggcccgctcccagccgccctgcagcccgtccggcaccgccagctccatgtcgcacgtggaggactcggactcggacgcgccgccgtctcccgccggctccgagggcctgggccgcgcgggggtcgcggtggggggcgcccggggcgacccggcggaggcggcggacgagcgcttcccggcctgcatccgcgacgccgtgtcgcaggtgctcaagggctacgactggagtctggtgcccatgccggtgcgcggcggcggcggcggcgcgctcaaagccaagccgcatgtgaagcggcccatgaacgcattcatggtgtgggcgcaggcggcgcgccgcaagctggccgaccagtacccgcacctgcacaacgccgagctcagcaagacgctgggcaagctgtggcgcttgctgagcgagagcgagaagcggcccttcgtggaggaggcagagcgccttcgcgtgcagcacaagaaggaccaccccgactacaagtaccagccacggcgcaggaagagcgccaaagccggccacagcgactccgactcgggcgcggagctgggaccccaccctggcggcggtgccgtgtacaaggctgaagcagggcttggagatgggcaccaccatggcgaccacacagggcagacccacgggccgcccaccccgcccaccacccccaagacggagctgcagcaggcgggcgccaagccggagctgaagctggagggacgccggccggtggacagcgggcgccagaacatcgacttcagcaatgtggacatctcggagctcagcagcgaggtcatgggcaccatggacgccttcgacgtccacgagttcgaccagtacctgcccctgggcggccccgccccacccgagccgggccaggcctatgggggcgcctacttccacgccggggcgtcccccgtgtgggcccacaagagtgccccgtcggcctccgcgtcgcccaccgagacgggtcccccacggccgcacatcaagacggagcagccgagccccggccactacggcgaccagccccgaggctcgcccgactacggttcctgcagcggccagtccagcgccaccccggccgcccccgccggccccttcgccggctcacagggcgactatggcgacctgcaggcctccagctactatggtgcctaccctggctacgcacccggcctctaccagtacccctgcttccactcgccgcgccggccctacgcctcacccctgctcaacggcctggccctgccgcccgcccacagccccaccagtcactgggaccagccggtgtacaccaccctgaccaggccc

SEQ ID NO: 147 - protein, 509 aa, Homo sapiens
MNLLDPFMKMTDEQEKGLSGAPSPTMSEDSAGSPCPSGSGSDTENTRPQENTFPKGEPDLKKESEEDKFPVCIREAVSQVLKGYDWTLVPMPVRVNGSSKNKPHVKRPMNAFMVWAQAARRKLADQYPHLHNAELSKTLGKLWRLLNESEKRPFVEEAERLRVQHKKDHPDYKYQPRRRKSVKNGQAEAEEATEQTHISPNAIFKALQADSPHSSSGMSEVHSPGEHSGQSQGPPTPPTTPKTDVQPGKADLKREGRPLPEGGRQPPIDFRDVDIGELSSDVISNIETFDVNEFDQYLPPNGHPGVPATHGQVTYTGSYGISSTAATPASAGHVWMSKQQAPPPPPQQPPQAPPAPQAPPQPQAAPPQQPAAPPQQPQAHTLTTLSSEPGQSQRTHIKTEQLSPSHYSEQQQHSPQQIAYSPFNLPHYSPSYPPITRSQYDYTDHQNSSSYYSHAAGQGTGLYSTFTYMNPAQRPMYTPIADTSGVPSIPQTHSPQHWEQPVYTQLTRP

SEQ ID NO: 148 - DNA, 1527 bp, Homo sapiens
atgaatctcctggaccccttcatgaagatgaccgacgagcaggagaagggcctgtccggcgcccccagccccaccatgtccgaggactccgcgggctcgccctgcccgtcgggctccggctcggacaccgagaacacgcggccccaggagaacacgttccccaagggcgagcccgatctgaagaaggagagcgaggaggacaagttccccgtgtgcatccgcgaggcggtcagccaggtgctcaaaggctacgactggacgctggtgcccatgccggtgcgcgtcaacggctccagcaagaacaagccgcacgtcaagcggcccatgaacgccttcatggtgtgggcgcaggcggcgcgcaggaagctcgcggaccagtacccgcacttgcacaacgccgagctcagcaagacgctgggcaagctctggagacttctgaacgagagcgagaagcggcccttcgtggaggaggcggagcggctgcgcgtgcagcacaagaaggaccacccggattacaagtaccagccgcggcggaggaagtcggtgaagaacgggcaggcggaggcagaggaggccacggagcagacgcacatctcccccaacgccatcttcaaggcgctgcaggccgactcgccacactcctcctccggcatgagcgaggtgcactcccccggcgagcactcggggcaatcccagggcccaccgaccccacccaccacccccaaaaccgacgtgcagccgggcaaggctgacctgaagcgagaggggcgccccttgccagaggggggcagacagccccctatcgacttccgcgacgtggacatcggcgagctgagcagcgacgtcatctccaacatcgagaccttcgatgtcaacgagtttgaccagtacctgccgcccaacggccacccgggggtgccggccacgcacggccaggtcacctacacgggcagctacggcatcagcagcaccgcggccaccccggcgagcgcgggccacgtgtggatgtccaagcagcaggcgccgccgccacccccgcagcagcccccacaggccccgccggccccgcaggcgcccccgcagccgcaggcggcgcccccacagcagccggcggcacccccgcagcagccacaggcgcacacgctgaccacgctgagcagcgagccgggccagtcccagcgaacgcacatcaagacggagcagctgagccccagccactacagcgagcagcagcagcactcgccccaacagatcgcctacagccccttcaacctcccacactacagcccctcctacccgcccatcacccgctcacagtacgactacaccgaccaccagaactccagctcctactacagccacgcggcaggccagggcaccggcctctactccaccttcacctacatgaaccccgctcagcgccccatgtacacccccatcgccgacacctctggggtcccttccatcccgcagacccacagcccccagcactgggaacaacccgtctacacacagctcactcgacct

SEQ ID NO: 149 - protein, 466 aa, Homo sapiens
MAEEQDLSEVELSPVGSEEPRCLSPGSAPSLGPDGGGGGSGLRASPGPGELGKVKKEQQDGEADDDKFPVCIREAVSQVLSGYDWTLVPMPVRVNGASKSKPHVKRPMNAFMVWAQAARRKLADQYPHLHNAELSKTLGKLWRLLNESDKRPFIEEAERLRMQHKKDHPDYKYQPRRRKNGKAAQGEAECPGGEAEQGGTAAIQAHYKSAHLDHRHPGEGSPMSDGNPEHPSGQSHGPPTPPTTPKTELQSGKADPKRDGRSMGEGGKPHIDFGNVDIGEISHEVMSNMETFDVAELDQYLPPNGHPGHVSSYSAAGYGLGSALAVASGHSAWISKPPGVALPTVSPPGVDAKAQVKTETAGPQGPPHYTDQPSTSQIAYTSLSLPHYGSAFPSISRPQFDYSDHQPSGPYYGHSGQASGLYSAFSYMGPSQRPLYTAISDPSPSGPQSHSPTHWEQPVYTTLSRP

SEQ ID NO: 150 - DNA, 1398 bp, Homo sapiens
atggcggaggagcaggacctatcggaggtggagctgagccccgtgggctcggaggagccccgctgcctgtccccggggagcgcgccctcgctagggcccgacggcggcggcggcggatcgggcctgcgagccagcccggggccaggcgagctgggcaaggtcaagaaggagcagcaggacggcgaggcggacgatgacaagttccccgtgtgcatccgcgaggccgtcagccaggtgctcagcggctacgactggacgctggtgcccatgcccgtgcgcgtcaacggcgccagcaaaagcaagccgcacgtcaagcggcccatgaacgccttcatggtgtgggctcaggcagcgcgcaggaagctcgcggaccagtacccgcacctgcacaacgctgagctcagcaagacgctgggcaagctctggaggctgctgaacgaaagtgacaagcgccccttcatcgaggaggctgagcggctccgtatgcagcacaagaaagaccacccggactacaagtaccagcccaggcggcggaagaacgggaaggccgcccagggcgaggcggagtgccccggtggggaggccgagcaaggtgggaccgccgccatccaggcccactacaagagcgcccacttggaccaccggcacccaggagagggctcccccatgtcagatggtaaccccgagcacccctcaggccagagccatggcccacccacccctccaaccaccccgaagacagagctgcagtcgggcaaggcagacccgaagcgggacgggcgctccatgggggagggcgggaagcctcacatcgacttcggcaacgtggacattggtgagatcagccacgaggtaatgtccaacatggagacctttgatgtggctgagttggaccagtacctgccgcccaatgggcacccaggccatgtgagcagctactcagcagccggctatgggctgggcagtgccctggccgtggccagtggacactccgcctggatctccaagccaccaggcgtggctctgcccacggtctcaccacctggtgtggatgccaaagcccaggtgaagacagagaccgcggggccccaggggcccccacactacaccgaccagccatccacctcacagatcgcctacacctccctcagcctgccccactatggctcagccttcccctccatctcccgcccccagtttgactactctgaccatcagccctcaggaccctattatggccactcgggccaggcctctggcctctactcggccttctcctatatggggccctcgcagcggcccctctacacggccatctctgaccccagcccctcagggccccagtcccacagccccacacactgggagcagccagtatatacgacactgtcccggccc

SEQ ID NO: 151 - protein, 388 aa, Homo sapiens [sequence omitted]

SEQ ID NO: 152 - DNA, 1164 bp, Homo sapiens
atggcttcgctgctgggagcctacccttggcccgagggtctcgagtgcccggccctggacgccgagctgtcggatggacaatcgccgccggccgtcccccggcccccgggggacaagggctccgagagccgtatccggcggcccatgaacgccttcatggtttgggccaaggacgagaggaaacggctggcagtgcagaacccggacctgcacaacgccgagctcagcaagatgctgggaaagtcgtggaaggcgctgacgctgtcccagaagaggccgtacgtggacgaggcggagcggctgcgcctgcagcacatgcaggactaccccaactacaagtaccggccgcgcaggaagaagcaggccaagcggctgtgcaagcgcgtggacccgggcttccttctgagctccctctcccgggaccagaacgccctgccggagaagagaagcggcagccggggggcgctgggggagaaggaggacaggggtgagtactcccccggcactgccctgcccagcctccggggctgctaccacgaggggccggctggtggtggcggcggcggcaccccgagcagtgtggacacgtacccgtacgggctgcccacacctcctgaaatgtctcccctggacgtgctggagccggagcagaccttcttctcctccccctgccaggaggagcatggccatccccgccgcatcccccacctgccagggcacccgtactcaccggagtacgccccaagccctctccactgtagccaccccctgggctccctggcccttggccagtcccccggcgtctccatgatgtcccctgtacccggctgtcccccatctcctgcctattactccccggccacctaccacccactccactccaacctccaagcccacctgggccagctttccccgcctcctgagcaccctggcttcgacgccctggatcaactgagccaggtggaactcctgggggacatggatcgcaatgaattcgaccagtatttgaacactcctggccacccagactccgccacaggggccatggccctcagtgggcatgttccggtctcccaggtgacaccaacgggtcccacagagaccagcctcatctccgtcctggctgatgccacggccacgtactacaacagctacagtgtgtca

SEQ ID NO: 153 - protein, 414 aa, Homo sapiens [sequence omitted]

SEQ ID NO: 154 - DNA, 1242 bp, Homo sapiens
atgagcagcccggatgcgggatacgccagtgacgaccagagccagacccagagcgcgctgcccgcggtgatggccgggctgggcccctgcccctgggccgagtcgctgagccccatcggggacatgaaggtgaagggcgaggcgccggcgaacagcggagcaccggccggggccgcgggccgagccaagggcgagtcccgtatccggcggccgatgaacgctttcatggtgtgggctaaggacgagcgcaagcggctggcgcagcagaatccagacctgcacaacgccgagttgagcaagatgctgggcaagtcgtggaaggcgctgacgctggcggagaagcggcccttcgtggaggaggcagagcggctgcgcgtgcagcacatgcaggaccaccccaactacaagtaccggccgcggcggcgcaagcaggtgaagcggctgaagcgggtggagggcggcttcctgcacggcctggctgagccgcaggcggccgcgctgggccccgagggcggccgcgtggccatggacggcctgggcctccagttccccgagcagggcttccccgccggcccgccgctgctgcctccgcacatgggcggccactaccgcgactgccagagtctgggcgcgcctccgctcgacggctacccgttgcccacgcccgacacgtccccgctggacggcgtggaccccgacccggctttcttcgccgccccgatgcccggggactgcccggcggccggcacctacagctacgcgcaggtctcggactacgctggccccccggagcctcccgccggtcccatgcacccccgactcggcccagagcccgcgggtccctcgattccgggcctcctggcgccacccagcgcccttcacgtgtactacggcgcgatgggctcgcccggggcgggcggcgggcgcggcttccagatgcagccgcaacaccagcaccagcaccagcaccagcaccaccccccgggccccggacagccgtcgccccctccggaggcactgccctgccgggacggcacggaccccagtcagcccgccgagctcctcggggaggtggaccgcacggaatttgaacagtatctgcacttcgtgtgcaagcctgagatgggcctcccctaccaggggcatgactccggtgtgaatctccccgacagccacggggccatttcctcggtggtgtccgacgccagctccgcggtatattactgcaactatcctgacgtg

SEQ ID NO: 155 - protein, 387 aa, Homo sapiens
MQRSPPGYGAQDDPPARRDCAWAPGHGAAADTRGLAAGPAALAAPAAPASPPSPQRSPPRSPEPGRYGLSPAGRGERQAADESRIRRPMNAFMVWAKDERKRLAQQNPDLHNAVLSKMLGKAWKELNAAEKRPFVEEAERLRVQHLRDHPNYKYRPRRKKQARKARRLEPGLLLPGLAPPQPPPEPFPAASGSARAFRELPPLGAEFDGLGLPTPERSPLDGLEPGEAAFFPPPAAPEDCALRPFRAPYAPTELSRDPGGCYGAPLAEALRTAPPAAPLAGLYYGTLGTPGPYPGPLSPPPEAPPLESAEPLGPAADLWADVDLTEFDQYLNCSRTRPDAPGLPYHVALAKLGPRAMSCPEESSLISALSDASSAVYYSACISGSGP

SEQ ID NO: 156 - DNA, 1161 bp, Homo sapiens
atgcagagatcgccgcccggctacggcgcacaggacgacccgcccgcccgccgcgactgtgcatgggccccgggacacggggccgccgctgacacgcgcggcctcgccgccggccccgccgccctcgccgcgcccgccgcgcccgcctcgccgcccagcccgcagcgcagtcccccgcgcagccccgagccggggcgctatggcctcagcccggccggccgcggggaacgccaggcggcagacgagtcgcgcatccggcggcccatgaacgccttcatggtgtgggcaaaggacgagcgcaagcggctggctcagcagaacccggacctgcacaacgcggtgctcagcaagatgctgggcaaagcgtggaaggagctgaacgcggcggagaagcggcccttcgtggaggaagccgaacggctgcgcgtgcagcacttgcgcgaccaccccaactacaagtaccggccgcgccgcaagaagcaggcgcgcaaggcccggcggctggagcccggcctcctgctcccgggattagcgcccccgcagccaccgcccgagcctttccccgcggcgtctggctcggctcgcgccttccgcgagctgcccccgctgggcgccgagttcgacggcctggggctgcccacgcccgagcgctcgcctctggacggcctggagcccggcgaggctgccttcttcccaccgcccgcggcgcccgaggactgcgcgctgcggcccttccgcgcgccctacgcgcccaccgagttgtcgcgggaccccggcggttgctacggggctcccctggcggaggcgctcaggaccgcgccccccgcggcgccgctcgctggcctgtactacggcaccctgggcacgcccggcccgtaccccggcccgctgtcgccgccgcccgaggccccgccgctggagagcgccgagccgctggggcccgccgccgatctgtgggccgacgtggacctcaccgagttcgaccagtacctcaactgcagccggactcggcccgacgcccccgggctcccgtaccacgtggcactggccaaactgggcccgcgcgccatgtcctgcccagaggagagcagcctgatctccgcgctgtcggacgccagcagcgcggtctattacagcgcgtgcatctccggcagcggaccg

SEQ ID NO: 157 - protein, 233 aa, Homo sapiens [sequence omitted]

SEQ ID NO: 158 - DNA, 699 bp, Homo sapiens
atggcgctaccaggctcctcacaggaccaggcctggagcctggagcctccggctgccacggctgctgcctcctcatcttcgggaccccaggagcgggagggcgctgggagccccgcggcccccgggacgctgcccctggagaaggtgaagcggccgatgaacgcgttcatggtgtggagctccgctcagcgccgccagatggcgcagcagaaccccaagatgcacaactccgagatctccaagcgcctgggcgcgcagtggaagctgctggacgaggacgagaagcggcccttcgtggaggaggccaagcggctccgcgcccgacacctgcgcgactaccccgactacaagtaccggcctcggcgcaaggccaagagctcgggcgccggaccttcccgctgcggacagggaagaggcaacctggccagcggcggcccgctctgggggccggggtacgcgaccacccaaccgagcagaggctttgggtacagaccccccagctactcgacagcctacctgcctggcagctatggctcttcccactgcaaactggaagccccctcaccgtgctccctccctcagagtgaccctaggctccagggggaactgctgcccacctatacccactacctgccccctggctctcccactccatacaaccctccccttgctggtgcccccatgcccctaacccacctc

SEQ ID NO: 159 - protein, 753 aa, Homo sapiens [sequence omitted]

SEQ ID NO: 160 - DNA, 2259 bp, Homo sapiens
atggagagagccagacccgagccgccgcctcagccgcgcccgttgcgtcccgctccgcccccgctgccggtcgagggcacctccttttgggcagcagccatggagccccctccgtcgtctcccacactgagcgcggcagccagtgcgaccttggcctcgtcgtgcggggaggcagtggcgtccggcttacagcccgcggtgcggcggctgctgcaggtgaagccagagcaggtgttgctgctaccacagcctcaggcccagaacgaggaagccgctgcctcgtccgcgcaggcgcggctgttgcagttcaggcccgacctgcggctcctgcagccgccgacagcgtcagacggcgccacctccaggcccgagttgcacccggtgcagcccctggcgctgcatgtcaaggccaagaagcagaagctggggcccagcctggatcagtcagtggggcctcgaggggccgtcgaaaccggtcctagagcctccagggtggtcaagttggaaggccccgggccggccctcggctacttccgaggggacgagaagggcaagctggaggcggaggaggtcatgagagactcgatgcaaggcggggcaggcaaaagcccggcagccatccgagaaggtgtgatcaaaacggaggaacccgagagactcctcgaggactgcaggctcggcgcggagcccgcgtccaatggcctggttcatggcagcgcggaggtcatcttggccccaacgtccggtgcctttgggccgcaccagcaagaccttaggatccctttgacgctccacacggtcccccctggggcccggatccagtttcagggagctccgccttcagagctgataagattgaccaaggtccccctgacaccagtgcctactaaaatgcagtccctactggagccttctgtaaaaattgaaaccaaagatgtcccgctcaccgtgttgccctcagatgcaggcataccagatactcccttcagtaaggacagaaatggtcatgtgaagcgacccatgaacgcatttatggtttgggcaaggatccaccgaccagcactagccaaagctaacccagcagccaacaatgcagaaatcagtgtccagcttgggttagagtggaacaaacttagtgaagaacaaaagaaaccctattacgatgaagcacaaaagattaaggaaaagcacagagaggaatttcctggttgggtttatcagcctcgtccagggaagcgaaaacgattccctctaagtgtttccaatgtattttctggtaccacaaagaatatcatctctacaaatcctacaacagtttatccttaccgctcacctacgtactctgtggtaattcccagcctacagaatcccatcactcatccagttggtgaaacctcacctgctatccagctgcccacacctgcagtccagagcccaagccctgtcacacttttccagcccagcgtctccagtgctgctcaggtggctgtccaggatccaagtctacctgtctatccagcactcccaccccaacgctttactgggccttcccaaacagacactcatcagctgcattctgaagccactcacactgtgaagcaacccactcctgtctctctagagagcgccaacaggatttcaagtagtgcaagtactgcccatgccagatttgcaacttcgaccatccaacctcctagggagtattccagcgtttccccttgtcccagaagtgctccaatcccccaggcttctcccattccacacccacatgtctaccagccccctccccttggccatccagccacactgttcgggacaccaccaagattctcttttcatcacccttacttcctacccggacctcactacttcccatcaagtacatgcccttacagtcggcctccctttggctatggaaattttccgagttcaatgccagaatgccttagttattatgaagacaggtacccaaaacatgagggtatcttttcaactttaaatagagactattcttttagagactactcaagtgaatgcacacacagtgaaaattctcggagttgtgagaacatgaatggaacttcttactataacagtcatagccacagtggggaagaaaacttaaaccctgtgcctcagctggacattggaaccttggagaatgtcttcacagccccgacatcaactccttctagcatccagcaagtcaatgtcaccgacagtgatgaggaggaagaagaaaaagtgctcagggattta

SEQ ID NO: 161 - protein, 251 aa, Homo sapiens
MPSPRPRGSPPPAPSGSRVRPPRSGRSPAPRSPTGPNTPRAPGRFESPFSVEAILARPDPCAPAASQPSGSACVHPAFWTAASLCATGGLPWACPTSWLPAYLSVGFYPVPGPRVAPVCGLLGFGVTGLELAHCSGLWAFPDWAPTEDLQDTERQQKRVRTMFNLEQLEELEKVFAKQHNLVGKKRAQLAARLKLTENQVRVWFQNRRVKYQKQQKLRAAVTSAEAASLDEPSSSSIASIQSDDAESGVDG

SEQ ID NO: 162 - DNA, 753 bp, Homo sapiens
atgcctagccccaggccgcgaggcagcccgccacccgctccctcgggctctcgggtccgacctccgcgctctggccgctctccggcgcccaggtcccctactggcccgaacacgccccgcgctcccggacgcttcgagtcccctttctcggtcgaggccatcctggcgaggcccgacccctgcgcgccggcggcctcccagccgtcgggctccgcctgcgtccacccggccttctggaccgctgcttccctgtgcgccaccgggggtctgccctgggcttgcccgacatcgtggctgcccgcctacctgagcgtaggtttttaccctgtgccagggccgcgcgtggctcccgtctgcggcctgctgggcttcggcgtcacagggttggagctggctcactgctcaggactctgggccttcccagactgggccccaacggaggacctacaggacactgagagacagcaaaagagagtccgaactatgtttaacttggagcagctggaagagttggagaaagtgtttgcaaaacagcacaatctggtggggaagaagagagcccagctggcagctcggctcaaacttacagagaaccaggtgagagtctggttccagaaccgcagggtcaagtatcagaagcagcaaaagctgagggcagcagttacatctgccgaggctgcctccctggatgagccttccagcagctccatcgccagtatccagagtgatgatgccgagtcaggagtggacggc

SEQ ID NO: 163 - protein, 317 aa, Homo sapiens
MAKNPPENCEDCHILNAEAFKSKKICKSLKICGLVFGILTLTLIVLFWGSKHFWPEVPKKAYDMEHTFYSSGEKKKIYMEIDPVTRTEIFRSGNGTDETLEVHDFKNGYTGIYFVGLQKCFIKTQIKVIPEFSEPEEEIDENEEITTTFFEQSVIWVPAEKPIENRDFLKNSKILEICDNVTMYWINPTLISVSELQDFEEEGEDLHFPANEKKGIEQNEQWVVPQVKVEKTRHARQASEEELPINDYTENGIEFDPMLDERGYCCIYCRRGNRYCRRVCEPLLGYYPYPYCYQGGRVICRVIMPCNWWVARMLGRV

SEQ ID NO: 164 - DNA, 951 bp, Homo sapiens
atggcaaagaatcctccagagaattgtgaagactgtcacattctaaatgcagaagcttttaaatccaagaaaatatgtaaatcacttaagatttgtggactggtgtttggtatcctgaccctaactctaattgtcctgttttgggggagcaagcacttctggccggaggtacccaaaaaagcctatgacatggagcacactttctacagcagtggagagaagaagaagatttacatggaaattgatcctgtgaccagaactgaaatattcagaagcggaaatggcactgatgaaacattggaagtacacgactttaaaaacggatacactggcatctacttcgtgggtcttcaaaaatgttttatcaaaactcagattaaagtgattcctgaattttctgaaccagaagaggaaatagatgagaatgaagaaattaccacaactttctttgaacagtcagtgatttgggtcccagcagaaaagcctattgaaaaccgagattttcttaaaaattccaaaattctggagatttgtgataacgtgaccatgtattggatcaatcccactctaatatcagtttctgagttacaagactttgaggaggagggagaagatcttcactttcctgccaacgaaaaaaaagggattgaacaaaatgaacagtgggtggtccctcaagtgaaagtagagaagacccgtcacgccagacaagcaagtgaggaagaacttccaataaatgactatactgaaaatggaatagaatttgatcccatgctggatgagagaggttattgttgtatttactgccgtcgaggcaaccgctattgccgccgcgtctgtgaacctttactaggctactacccatatccatactgctaccaaggaggacgagtcatctgtcgtgtcatcatgccttgtaactggtgggtggcccgcatgctggggagggtc

SEQ ID NO: 165 - protein, 716 aa, Homo sapiens
MPSTSFPVPSKFPLGPAAAVFGRGETLGPAPRAGGTMKSAEEEHYGYASSNVSPALPLPTAHSTLPAPCHNLQTSTPGIIPPADHPSGYGAALDGGPAGYFLSSGHTRPDGAPALESPRIEITSCLGLYHNNNQFFHDVEVEDVLPSSKRSPSTATLSLPSLEAYRDPSCLSPASSLSSRSCNSEASSYESNYSYPYASPQTSPWQSPCVSPKTTDPEEGFPRGLGACTLLGSPRHSPSTSPRASVTEESWLGARSSRPASPCNKRKYSLNGRQPPYSPHHSPTPSPHGSPRVSVTDDSWLGNTTQYTSSAIVAAINALTTDSSLDLGDGVPVKSRKTTLEQPPSVALKVEPVGEDLGSPPPPADFAPEDYSSFQHIRKGGFCDQYLAVPQHPYQWAKPKPLSPTSYMSPTLPALDWQLPSHSGPYELRIEVQPKSHHRAHYETEGSRGAVKASAGGHPIVQLHGYLENEPLMLQLFIGTADDRLLRPHAFYQVHRITGKTVSTTSHEAILSNTKVLEIPLLPENSMRAVIDCAGILKLRNSDIELRKGETDIGRKNTRVRLVFRVHVPQPSGRTLSLQVASNPIECSQRSAQELPLVEKQSTDSYPVVGGKKMVLSGHNFLQDSKVIFVEKAPDGHHVWEMEAKTDRDLCKPNSLVVEIPPFRNQRITSPVHVSFYVCNGKRKRSQYQRFTYLPANGNAIFLTVSREHERVGCFF

SEQ ID NO: 166 - DNA, 2148 bp, Homo sapiens
atgccaagcaccagctttccagtcccttccaagtttccacttggccctgcggctgcggtcttcgggagaggagaaactttggggcccgcgccgcgcgccggcggcaccatgaagtcagcggaggaagaacactatggctatgcatcctccaacgtcagccccgccctgccgctccccacggcgcactccaccctgccggccccgtgccacaaccttcagacctccacaccgggcatcatcccgccggcggatcacccctcggggtacggggcagctttggacggtgggcccgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgggttccccgcggcactccccctccacctcgccccgcgccagcgtcactgaggagagctggctgggtgcccgctcctccagacccgcgtccccgtgcaacaagaggaagtacagcctcaacggccggcagccgccctactcaccccaccactcgcccacgccgtccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccatttcggaatcagaggataaccagccccgttcacgtcagtttctacgtctgcaacgggaagagaaagcgaagccagtaccagcgtttcacctaccttcccgccaacggtaacgccatctttctaaccgtaagccgtgaacatgagcgcgtggggtgctttttc

SEQ ID NO: 167 - protein, 921 aa, Homo sapiens
MNAPERQPQPDGGDAPGHEPGGSPQDELDFSILFDYEYLNPNEEEPNAHKVASPPSGPAYPDDVLDYGLKPYSPLASLSGEPPGRFGEPDRVGPQKFLSAAKPAGASGLSPRIEITPSHELIQAVGPLRMRDAGLLVEQPPLAGVAASPRFTLPVPGFEGYREPLCLSPASSGSSASFISDTFSPYTSPCVSPNNGGPDDLCPQFQNIPAHYSPRTSPIMSPRTSLAEDSCLGRHSPVPRPASRSSSPGAKRRHSCAEALVALPPGASPQRSRSPSPQPSSHVAPQDHGSPAGYPPVAGSAVIMDALNSLATDSPCGIPPKMWKTSPDPSPVSAAPSKAGLPRHIYPAVEFLGPCEQGERRNSAPESILLVPPTWPKPLVPAIPICSIPVTASLPPLEWPLSSQSGSYELRIEVQPKPHHRAHYETEGSRGAVKAPTGGHPVVQLHGYMENKPLGLQIFIGTADERILKPHAFYQVHRITGKTVTTTSYEKIVGNTKVLEIPLEPKNNMRATIDCAGILKLRNADIELRKGETDIGRKNTRVRLVFRVHIPESSGRIVSLQTASNPIECSQRSAHELPMVERQDTDSCLVYGGQQMILTGQNFTSESKVVFTEKTTDGQQIWEMEATVDKDKSQPNMLFVEIPEYRNKHIRTPVKVNFYVINGKRKRSQPQHFTYHPVPAIKTEPTDEYDPTLICSPTHGGLGSQPYYPQHPMVAESPSCLVATMAPCQQFRTGLSSPDARYQQQNPAAVLYQRSKSLSPSLLGYQQPALMAAPLSLADAHRSVLVHAGSQGQSSALLHPSPTNQQASPVIHYSPTNQQLRCGSHQEFQHIMYCENFAPGTTRPGPPPVSQGQRLSPGSYPTVIQQQNATSQRAAKNGPPVSDQKEVLPAGVTIKQEQNLDQTYLDDELIDTHLSWIQNIL

SEQ ID NO: 168 - DNA, 2763 bp, Homo sapiens
atgaacgcccccgagcggcagccccaacccgacggcggggacgccccaggccacgagcctgggggcagcccccaagacgagcttgacttctccatcctcttcgactatgagtatttgaatccgaacgaagaagagccgaatgcacataaggtcgccagcccaccctccggacccgcataccccgatgatgtcctggactatggcctcaagccatacagcccccttgctagtctctctggcgagccccccggccgattcggagagccggatagggtagggccgcagaagtttctgagcgcggccaagccagcaggggcctcgggcctgagccctcggatcgagatcactccgtcccacgaactgatccaggcagtggggcccctccgcatgagagacgcgggcctcctggtggagcagccgcccctggccggggtggccgccagcccgaggttcaccctgcccgtgcccggcttcgagggctaccgcgagccgctttgcttgagccccgctagcagcggctcctctgccagcttcatttctgacaccttctccccctacacctcgccctgcgtctcgcccaataacggcgggcccgacgacctgtgtccgcagtttcaaaacatccctgctcattattcccccagaacctcgccaataatgtcacctcgaaccagcctcgccgaggacagctgcctgggccgccactcgcccgtgccccgtccggcctcccgctcctcatcgcctggtgccaagcggaggcattcgtgcgccgaggccttggttgccctgccgcccggagcctcaccccagcgctcccggagcccctcgccgcagccctcatctcacgtggcaccccaggaccacggctccccggctgggtacccccctgtggctggctctgccgtgatcatggatgccctgaacagcctcgccacggactcgccttgtgggatcccccccaagatgtggaagaccagccctgacccctcgccggtgtctgccgccccatccaaggccggcctgcctcgccacatctacccggccgtggagttcctggggccctgcgagcagggcgagaggagaaactcggctccagaatccatcctgctggttccgcccacttggcccaagccgctggtgcctgccattcccatctgcagcatcccagtgactgcatccctccctccacttgagtggccgctgtccagtcagtcaggctcttacgagctgcggatcgaggtgcagcccaagccacatcaccgggcccactatgagacagaaggcagccgaggggctgtcaaagctccaactggaggccaccctgtggttcagctccatggctacatggaaaacaagcctctgggacttcagatcttcattgggacagctgatgagcggatccttaagccgcacgccttctaccaggtgcaccgaatcacggggaaaactgtcaccaccaccagctatgagaagatagtgggcaacaccaaagtcctggagatacccttggagcccaaaaacaacatgagggcaaccatcgactgtgcggggatcttgaagcttagaaacgccgacattgagctgcggaaaggcgagacggacattggaagaaagaacacgcgggtgagactggttttccgagttcacatcccagagtccagtggcagaatcgtctctttacagactgcatctaaccccatcgagtgctcccagcgatctgctcacgagctgcccatggttgaaagacaagacacagacagctgcctggtctatggcggccagcaaatgatcctcacggggcagaactttacatccgagtccaaagttgtgtttactgagaagaccacagatggacagcaaatttgggagatggaagccacggtggataaggacaagagccagcccaacatgctttttgttgagatccctgaatatcggaacaagcatatccgcacacctgtaaaagtgaacttctacgtcatcaatgggaagagaaaacgaagtcagcctcagcactttacctaccacccagtcccagccatcaagacggagcccacggatgaatatgaccccactctgatctgcagccccacccatggaggcctggggagccagccttactacccccagcacccgatggtggccgagtccccctcctgcctcgtggccaccatggctccctgccagcagttccgcacggggctctcatcccctgacgcccgctaccagcaacagaacccagcggccgtactctaccagcggagcaagagcctgagccccagcctgctgggctatcagcagccggccctcatggccgccccgctgtcccttgcggacgctcaccgctctgtgctggtgcacgccggctcccagggccagagctcagccctgctccacccctctccgaccaaccagcaggcctcgcctgtgatccactactcacccaccaaccagcagctgcgctgcggaagccaccaggagttccagcacatcatgtactgcgagaatttcgcaccaggcaccaccagacctggcccgcccccggtcagtcaaggtcagaggctgagcccgggttcctaccccacagtcattcagcagcagaatgccacgagccaaagagccgccaaaaacggacccccggtcagtgaccaaaaggaagtattacctgcgggggtgaccattaaacaggagcagaacttggaccagacctacttggatgatgagctgatagacacacaccttagctggatacaaaacatatta

SEQ ID NO: 169 - protein, 1068 aa, Homo sapiens
MTTANCGAHDELDFKLVFGEDGAPAPPPPGSRPADLEPDDCASIYIFNVDPPPSTLTTPLCLPHHGLPSHSSVLSPSFQLQSHKNYEGTCEIPESKYSPLGGPKPFECPSIQITSISPNCHQELDAHEDDLQINDPEREFLERPSRDHLYLPLEPSYRESSLSPSPASSISSRSWFSDASSCESLSHIYDDVDSELNEAAARFTLGSPLTSPGGSPGGCPGEETWHQQYGLGHSLSPRQSPCHSPRSSVTDENWLSPRPASGPSSRPTSPCGKRRHSSAEVCYAGSLSPHHSPVPSPGHSPRGSVTEDTWLNASVHGGSGLGPAVFPFQYCVETDIPLKTRKTSEDQAAILPGKLELCSDDQGSLSPARETSIDDGLGSQYPLKKDSCGDQFLSVPSPFTWSKPKPGHTPIFRTSSLPPLDWPLPAHFGQCELKIEVQPKTHHRAHYETEGSRGAVKASTGGHPVVKLLGYNEKPINLQMFIGTADDRYLRPHAFYQVHRITGKTVATASQEIIIASTKVLEIPLLPENNMSASIDCAGILKLRNSDIELRKGETDIGRKNTRVRLVFRVHIPQPSGKVLSLQIASIPVECSQRSAQELPHIEKYSINSCSVNGGHEMVVTGSNFLPESKIIFLEKGQDGRPQWEVEGKIIREKCQGAHIVLEVPPYHNPAVTAAVQVHFYLCNGKRKKSQSQRFTYTPVLMKQEHREEIDLSSVPSLPVPHPAQTQRPSSDSGCSHDSVLSGQRSLICSIPQTYASMVTSSHLPQLQCRDESVSKEQHMIPSPIVHQPFQVTPTPPVGSSYQPMQTNVVYNGPTCLPINAASSQEFDSVLFQQDATLSGLVNLGCQPLSSIPFHSSNSGSTGHLLAHTPHSVHTLPHLQSMGYHCSNTGQRSLSSPVADQITGQPSSQLQPITYGPSHSGSATTASPAASHPLASSPLSGPPSPQLQPMPYQSPSSGTASSPSPATRMHSGQHSTQAQSTGQGGLSAPSSLICHSLCDPASFPPDGATVSIKPEPEDREPNFATIGLQDITLDDDQFISDLEHQPSGSAEKWPNHSVLSCPAPFWRI

SEQ ID NO: 170 - DNA, 3204 bp, Homo sapiens
atgactactgcaaactgtggcgcccacgacgagctcgacttcaaactcgtctttggcgaggacggggcgccggcgccgccgcccccgggctcgcggcctgcagatcttgagccagatgattgtgcatccatttacatctttaatgtagatccacctccatctactttaaccacaccactttgcttaccacatcatggattaccgtctcactcttctgttttgtcaccatcgtttcagctccaaagtcacaaaaactatgaaggaacttgtgagattcctgaatctaaatatagcccattaggtggtcccaaaccctttgagtgcccaagtattcaaattacatctatctctcctaactgtcatcaagaattagatgcacatgaagatgacctacagataaatgacccagaacgggaatttttggaaaggccttctagagatcatctctatcttcctcttgagccatcctaccgggagtcttctcttagtcctagtcctgccagcagcatctcttctaggagttggttctctgatgcatcttcttgtgaatcgctttcacatatttatgatgatgtggactcagagttgaatgaagctgcagcccgatttacccttggatcccctctgacttctcctggtggctctccagggggctgccctggagaagaaacttggcatcaacagtatggacttggacactcattatcacccaggcaatctccttgccactctcctagatccagtgtcactgatgagaattggctgagccccaggccagcctcaggaccctcatcaaggcccacatccccctgtgggaaacggaggcactccagtgctgaagtttgttatgctgggtccctttcaccccatcactcacctgttccttcacctggtcactcccccaggggaagtgtgacagaagatacgtggctcaatgcttctgtccatggtgggtcaggccttggccctgcagtttttccatttcagtactgtgtagagactgacatccctctcaaaacaaggaaaacttctgaagatcaagctgccatactaccaggaaaattagagctgtgttcagatgaccaagggagtttatcaccagcccgggagacttcaatagatgatggccttggatctcagtatcctttaaagaaagattcatgtggtgatcagtttctttcagttccttcaccctttacctggagcaaaccaaagcctggccacacccctatatttcgcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagtattgattgtgcaggtattttgaaactccgcaattcagatatagaacttcgaaaaggagaaactgatattggcagaaagaatactagagtacgacttgtgtttcgtgtacacatcccacagcccagtggaaaagtcctttctctgcagatagcctctatacccgttgagtgctcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaagatggacgacctcagtgggaggtagaagggaagataatcagggaaaaatgtcaaggggctcacattgtccttgaagttcctccatatcataacccagcagttacagctgcagtgcaggtgcacttttatctttgcaatggcaagaggaaaaaaagccagtctcaacgttttacttatacaccagttttgatgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagttttgtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtggctgaccagattacaggtcagccttcgtctcagttacaacctattacatatggtccttcacattcagggtctgctacaacagcttccccagcagcttctcatcccttggctagttcaccgctttctgggccaccatctcctcagcttcagcctatgccttaccaatctcctagctcaggaactgcctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatgaccaatttatatctgacttggaacaccagccatcaggttcagcagagaaatggcctaaccacagtgtgctctcatgtccagctcctttctggagaatc

SEQ ID NO: 171 - protein, 964 aa, Homo sapiens
MITTLPSLLPASLASISHRVTNLPSNSLSHNPGLSKPDFPGNSSPGLPSSSSPGRDLGAPAGSMGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEGGCGTGGCECECVQEIALHVC

SEQ ID NO: 172 - DNA, 2892 bp, Homo sapiens
atgataaccaccctcccatctctcctacccgccagcctcgccagtatctcccaccgagtcacgaatctcccatctaactccctctcacacaacccaggcctctccaagcctgactttcccggaaactccagtccaggtcttccttcctcctccagcccaggccgggacctgggggctcctgccggatccatgggggcggccagctgcgaggatgaggagctggaatttaagctggtgttcggggaggaaaaggaggcccccccgctgggcgcggggggattgggggaagaactggactcagaggatgccccgccatgctgccgtctggccttgggagagccccctccctatggcgctgcacctatcggtattccccgacctccaccccctcggcctggcatgcattcgccaccgccgcgaccagccccctcacctggcacctgggagagccagcccgccaggtcggtgaggctgggaggaccaggagggggtgctgggggtgctgggggtggccgtgttctcgagtgtcccagcatccgcatcacctccatctctcccacgccggagccgccagcagcgctggaggacaaccctgatgcctggggggacggctctcctagagattaccccccaccagaaggctttgggggctacagagaagcagggggccagggtgggggggccttcttcagcccaagccctggcagcagcagcctgtcctcgtggagcttcttctccgatgcctctgacgaggcagccctgtatgcagcctgcgacgaggtggagtctgagctaaatgaggcggcctcccgctttggcctgggctccccgctgccctcgccccgggcctcccctcggccatggacccccgaagatccctggagcctgtatggtccaagccccggaggccgagggccagaggatagctggctactcctcagtgctcctgggcccaccccagcctccccgcggcctgcctctccatgtggcaagcggcgctattccagctcgggaaccccatcttcagcctccccagctctgtcccgccgtggcagcctgggggaagaggggtctgagccacctccaccacccccattgcctctggcccgggacccgggctcccctggtccctttgactatgtgggggccccaccagctgagagcatccctcagaagacacggcggacttccagcgagcaggcagtggctctgcctcggtctgaggagcctgcctcatgcaatgggaagctgcccttgggagcagaggagtctgtggctcctccaggaggttcccggaaggaggtggctggcatggactacctggcagtgccctccccactcgcttggtccaaggcccggattgggggacacagccctatcttcaggacctctgccctacccccactggactggcctctgcccagccaatatgagcagctggagctgaggatcgaggtacagcctagagcccaccaccgggcccactatgagacagaaggcagccgtggagctgtcaaagctgcccctggcggtcaccccgtagtcaagctcctaggctacagtgagaagccactgaccctacagatgttcatcggcactgcagatgaaaggaacctgcggcctcatgccttctatcaggtgcaccgtatcacaggcaagatggtggccacggccagctatgaagccgtagtcagtggcaccaaggtgttggagatgactctgctgcctgagaacaacatggcggccaacattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctcccagcgctcagcccaggagctgccccaggtggaggcctacagccccagtgcctgctctgtgagaggaggcgaggaactggtactgactggctccaacttcctgccagactccaaggtggtgttcattgagaggggtcctgatgggaagctgcaatgggaggaggaggccacagtgaaccgactgcagagcaacgaggtgacgctgaccctgactgtccccgagtacagcaacaagagggtttcccggccagtccaggtctacttttatgtctccaatgggcggaggaaacgcagtcctacccagagtttcaggtttctgcctgtgatctgcaaagaggagcccctaccggactcatctctgcggggtttcccttcagcatcggcaaccccctttggcactgacatggacttctcaccacccaggcccccctacccctcctatccccatgaagaccctgcttgcgaaactccttacctatcagaaggcttcggctatggcatgccccctctgtacccccagacggggcccccaccatcctacagaccgggcctgcggatgttccctgagactaggggtaccacaggttgtgcccaaccacctgcagtttccttccttccccgccccttccctagtgacccgtatggagggcggggctcctctttctccctggggctgccattctctccgccagccccctttcggccgcctcctcttcctgcatccccaccgcttgaaggccccttcccttcccagagtgatgtgcatcccctacctgctgagggatacaataaggtagggccaggctatggccctggggagggggctccggagcaggagaaatccaggggtggctacagcagcggcttccgagacagtgtccctatccagggtatcacgctggaggaaggtgggtgtgggactgggggctgtgagtgtgagtgtgtgcaagagattgctctgcatgtttgc

SEQ ID NO: 173 - protein, 485 aa, Homo sapiens
IQTVPDPAAHIKEALSVVSEDQSLFECAYGTPHLAKTEMTASSSSDYGQTSKMSPRVPQQDWLSQPPARVTIKMECNPSQVNGSRNSPDECSVAKGGKMVGSPDTVGMNYGSYMEEKHMPPPNMTTNERRVIVPADPTLWSTDHVRQWLEWAVKEYGLPDVNILLFQNIDGKELCKMTKDDFQRLTPSYNADILLSHLHYLRETPLPHLTSDDVDKALQNSPRLMHARNTGGAAFIFPNTSVYPEATQRITTRPDLPYEPPRRSAWTGHGHPTPQSKAAQPSPSTVPKTEDQRPQLDPYQILGPTSSRLANPGSGQIQLWQFLLELLSDSSNSSCITWEGTNGEFKMTDPDEVARRWGERKSKPNMNYDKLSRALRYYYDKNIMTKVHGKRYAYKFDFHGIAQALQPHPPESSLYKYPSDLPYMGSYHAHPQKMNFVAPHPPALPVTSSSFFAAPNPYWNSPTGGIYPNTRLPTSHMPSHLGTYY

SEQ ID NO: 174 - DNA, 1458 bp, Homo sapiens
atgattcagactgtcccggacccagcagctcatatcaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagggggtgcagcttttattttcccaaatacttcagtatatcctgaagctacgcaaagaattacaactaggccagatttaccatatgagccccccaggagatcagcctggaccggtcacggccaccccacgccccagtcgaaagctgctcaaccatctccttccacagtgcccaaaactgaagaccagcgtcctcagttagatccttatcagattcttggaccaacaagtagccgccttgcaaatccaggcagtggccagatccagctttggcagttcctcctggagctcctgtcggacagctccaactccagctgcatcacctgggaaggcaccaacggggagttcaagatgacggatcccgacgaggtggcccggcgctggggagagcggaagagcaaacccaacatgaactacgataagctcagccgcgccctccgttactactatgacaagaacatcatgaccaaggtccatgggaagcgctacgcctacaagttcgacttccacgggatcgcccaggccctccagccccaccccccggagtcatctctgtacaagtacccctcagacctcccgtacatgggctcctatcacgcccacccacagaagatgaactttgtggcgccccaccctccagccctccccgtgacatcttccagtttttttgctgccccaaacccatactggaattcaccaactgggggtatataccccaacactaggctccccaccagccatatgccttctcatctgggcacttactac

SEQ ID NO: 175 - protein, 798 aa, Homo sapiens [sequence omitted]

SEQ ID NO: 176 - DNA, 2394 bp, Homo sapiens
atggcgtgggacatgtgcaaccaggactctgagtctgtatggagtgacatcgagtgtgctgctctggttggtgaagaccagcctctttgcccagatcttcctgaacttgatctttctgaactagatgtgaacgacttggatacagacagctttctgggtggactcaagtggtgcagtgaccaatcagaaataatatccaatcagtacaacaatgagccttcaaacatatttgagaagatagatgaagagaatgaggcaaacttgctagcagtcctcacagagacactagacagtctccctgtggatgaagacggattgccctcatttgatgcgctgacagatggagacgtgaccactgacaatgaggctagtccttcctccatgcctgacggcacccctccaccccaggaggcagaagagccgtctctacttaagaagctcttactggcaccagccaacactcagctaagttataatgaatgcagtggtctcagtacccagaaccatgcaaatcacaatcacaggatcagaacaaaccctgcaattgttaagactgagaattcatggagcaataaagcgaagagtatttgtcaacagcaaaagccacaaagacgtccctgctcggagcttctcaaatatctgaccacaaacgatgaccctcctcacaccaaacccacagagaacagaaacagcagcagagacaaatgcacctccaaaaagaagtcccacacacagtcgcagtcacaacacttacaagccaaaccaacaactttatctcttcctctgaccccagagtcaccaaatgaccccaagggttccccatttgagaacaagactattgaacgcaccttaagtgtggaactctctggaactgcaggcctaactccacccaccactcctcctcataaagccaaccaagataacccttttagggcttctccaaagctgaagtcctcttgcaagactgtggtgccaccaccatcaaagaagcccaggtacagtgagtcttctggtacacaaggcaataactccaccaagaaagggccggagcaatccgagttgtatgcacaactcagcaagtcctcagtcctcactggtggacacgaggaaaggaagaccaagcggcccagtctgcggctgtttggtgaccatgactattgccagtcaattaattccaaaacggaaatactcattaatatatcacaggagctccaagactctagacaactagaaaataaagatgtctcctctgattggcaggggcagatttgttcttccacagattcagaccagtgctacctgagagagactttggaggcaagcaagcaggtctctccttgcagcacaagaaaacagctccaagaccaggaaatccgagccgagctgaacaagcacttcggtcatcccagtcaagctgtttttgacgacgaagcagacaagaccagtgaactgagggacagtgatttcagtaatgaacaattctccaaactacctatgtttataaattcaggactagccatggatggcctgtttgatgacagcgaagatgaaagtgataaactgagctacccttgggatggcacacaatcctattcattgttcaatgtgtctccttcttgttcttcttttaactctccatgtagagattctgtgtcaccacccaaatccttattttctcaaagaccccaaaggatgcgctctcgttcaaggtccttttctcgacacaggtcgtgttcccgatcaccatattccaggtcaagatcaaggtctccaggcagtagatcctcttcaagatcctgctattactatgagtcaagccactacagacaccgcacgcaccgaaattctcccttgtatgtgagatcacgttcaagatcgccctacagccgtcggcccaggtatgacagctacgaggaatatcagcacgagaggctgaagagggaagaatatcgcagagagtatgagaagcgagagtctgagagggccaagcaaagggagaggcagaggcagaaggcaattgaagagcgccgtgtgatttatgtcggtaaaatcagacctgacacaacacggacagaactgagggaccgttttgaagtttttggtgaaattgaggagtgcacagtaaatctgcgggatgatggagacagctatggtttcattacctaccgttatacctgtgatgcttttgctgctcttgaaaatggatacactttgcgcaggtcaaacgaaactgactttgagctgtacttttgtggacgcaagcaatttttcaagtctaactatgcagacctagattcaaactcagatgactttgaccctgcttccaccaagagcaagtatgactctctggattttgatagtttactgaaagaagctcagagaagcttgcgcagg

SEQ ID NO: 177 - protein, 431 aa, Homo sapiens
MASSLLEEEVHYGSSPLAMLTAACSKFGGSSPLRDSTTLGKAGTKKPYSVGSDLSASKTMGDAYPAPFTSTNGLLSPAGSPPAPTSGYANDYPPFSHSFPGPTGTQDPGLLVPKGHSSSDCLPSVYTSLDMTHPYGSWYKAGIHAGISPGPGNTPTPWWDMHPGGNWLGGGQGQGDGLQGTLPTGPAQPPLNPQLPTYPSDFAPLNPAPYPAPHLLQPGPQHVLPQDVYKPKAVGNSGQLEGSGGAKPPRGASTGGSGGYGGSGAGRSSCDCPNCQELERLGAAAAGLRKKPIHSCHIPGCGKVYGKASHLKAHLRWHTGERPFVCNWLFCGKRFTRSDELERHVRTHTREKKFTCLLCSKRFTRSDHLSKHQRTHGEPGPGPPPSGPKELGEGRSTGEEEASQTPRPSASPATPEKAPGGSPEQSNLLEI

SEQ ID NO: 178 - DNA, 1293 bp, Homo sapiens
atggcgtcctccctgcttgaggaggaagttcactatggctccagtcccctggccatgctgacggcagcgtgcagcaaatttggtggctctagccctctgcgggactcaacaactctgggcaaagcaggcacaaagaagccgtactctgtgggcagtgacctttcagcctccaaaaccatgggggatgcttatccagccccctttacaagcactaatgggctcctttcacctgcaggcagtcctccagcacccacctcaggctatgctaatgattaccctcccttttcccactcattccctgggcccacaggcacccaggaccctgggctactagtgcccaaggggcacagctcttctgactgtctgcccagtgtctacacctctctggacatgacacacccctatggctcctggtacaaggcaggcatccatgcaggcatttcaccaggcccaggcaacactcctactccatggtgggatatgcaccctggaggcaactggctaggtggtgggcagggccagggtgatgggctgcaagggacactgcccacaggtccagctcagcctccactgaacccccagctgcccacctacccatctgactttgctccccttaatccagccccctacccagctccccacctcttgcaaccagggccccagcatgtcttgccccaagatgtctataaacccaaggcagtgggaaatagtgggcagctagaagggagtggtggagccaaacccccacggggtgcaagcactgggggtagtggtggatatgggggcagtggggcagggcgctcctcctgcgactgccctaattgccaggagctagagcggctgggagcagcagcggctgggctgcggaagaagcccatccacagctgccacatccctggctgcggcaaggtgtatggcaaggcttcgcacctgaaggcccacttgcgctggcacacaggcgagaggcccttcgtctgcaactggctcttctgcggcaagaggttcactcgttcggatgagctggagcgtcatgtgcgcactcacacccgggagaagaagttcacctgcctgctctgctccaagcgctttacccgaagtgaccacctgagcaaacaccagcgcacccacggagaaccaggcccgggtccccctcccagtggccccaaggagctgggggagggccgcagcacgggggaagaggaggccagtcagacgccccgaccttctgcctcgccagcaaccccagagaaagcccctggaggcagccctgagcagagcaacttgctggagatc

SEQ ID NO: 179 - protein, 473 aa, Homo sapiens
MGRKKIQITRIMDERNRQVTFTKRKFGLMKKAYELSVLCDCEIALIIFNSTNKLFQYASTDMDKVLLKYTEYNEPHESRTNSDIVETLRKKGLNGCDSPDPDADDSVGHSPESEDKYRKINEDIDLMISRQRLCAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVSEDVDLLLNQRINNSQSAQSLATPVVSVATPTLPGQGMGGYPSAISTTYGTEYSLSSADLSSLSGFNTASALHLGSVTGWQQQHLHNMPPSALSQLGACTSTHLSQSSNLSLPSTQSLNIKSEPVSPPRDRTTTPSRYPQHTRHEAGRSPVDSLSSCSSSYDGSDREDHRNEFHSPIGLTRPSPDERESPSVKRMRLSEGWAT

SEQ ID NO: 180 - DNA, 1419 bp, Homo sapiens
atggggagaaaaaagattcagattacgaggattatggatgaacgtaacagacaggtgacatttacaaagaggaaatttgggttgatgaagaaggcttatgagctgagcgtgctgtgtgactgtgagattgcgctgatcatcttcaacagcaccaacaagctgttccagtatgccagcaccgacatggacaaagtgcttctcaagtacacggagtacaacgagccgcatgagagccggacaaactcagacatcgtggagacgttgagaaagaagggccttaatggctgtgacagcccagaccccgatgcggacgattccgtaggtcacagccctgagtctgaggacaagtacaggaaaattaacgaagatattgatctaatgatcagcaggcaaagattgtgtgctgttccacctcccaacttcgagatgccagtctccatcccagtgtccagccacaacagtttggtgtacagcaaccctgtcagctcactgggaaaccccaacctattgccactggctcacccttctctgcagaggaatagtatgtctcctggtgtaacacatcgacctccaagtgcaggtaacacaggtggtctgatgggtggagacctcacgtctggtgcaggcaccagtgcagggaacgggtatggcaatccccgaaactcaccaggtctgctggtctcacctggtaacttgaacaagaatatgcaagcaaaatctcctcccccaatgaatttaggaatgaataaccgtaaaccagatctccgagttcttattccaccaggcagcaagaatacgatgccatcagtgtctgaggatgtcgacctgcttttgaatcaaaggataaataactcccagtcggctcagtcattggctaccccagtggtttccgtagcaactcctactttaccaggacaaggaatgggaggatatccatcagccatttcaacaacatatggtaccgagtactctctgagtagtgcagacctgtcatctctgtctgggtttaacaccgccagcgctcttcaccttggttcagtaactggctggcaacagcaacacctacataacatgccaccatctgccctcagtcagttgggagcttgcactagcactcatttatctcagagttcaaatctctccctgccttctactcaaagcctcaacatcaagtcagaacctgtttctcctcctagagaccgtaccaccaccccttcgagatacccacaacacacgcgccacgaggcggggagatctcctgttgacagcttgagcagctgtagcagttcgtacgacgggagcgaccgagaggatcaccggaacgaattccactcccccattggactcaccagaccttcgccggacgaaagggaaagtccctcagtcaagcgcatgcgactttctgaaggatgggcaaca

SEQ ID NO: 181 - protein, 352 aa, Homo sapiens
MNTIVFNKLSSAVLFEDGGASERERGGRPYSGVLDSPHARPEVGIPDGPPLKDNLGLRHRRTGARQNGGKVRHKRQALQDMARPLKQWLYKHRDNPYPTKTEKILLALGSQMTLVQVSNWFANARRRLKNTVRQPDLSWALRIKLYNKYVQGNAERLSVSSDDSCSEDGENPPRTHMNEGGYNTPVHHPVIKSENSVIKAGVRPESRASEDYVAPPKYKSSLLNRYLNDSLRHVMATNTTMMGKTRQRNHSGSFSSNEFEEELVSPSSSETEGNFVYRTDTLENGSNKGESAANRKGPSKDDTYWKEINAAMALTNLAQGKDKLQGTTSCIIQKSSHIAEVKTVKVPLVQQF

SEQ ID NO: 182 - DNA, 1056 bp, Homo sapiens
atgaacaccatcgtcttcaacaagctcagctctgcggtgctgtttgaggacggaggcgcctcggagcgggagcggggtggccggccctacagcggtgtcctggacagtcctcacgcccgccccgaggtgggcattcccgacggcccgcccctcaaggacaacctcggcctgagacaccggaggaccggcgcccggcagaatggcgggaaggtgaggcacaagcggcaggccctgcaagacatggcgcgacccctcaagcagtggctttacaagcaccgtgacaacccgtaccccaccaagaccgagaagatactcttggccctcggctcgcagatgacgctagtgcaggtgtcaaattggtttgctaatgcaagacgtcggcttaagaataccgttcgacagccagatttaagctgggctttgagaataaagttatacaacaagtatgttcaaggcaatgctgaacggcttagcgtaagcagtgatgactcatgttctgaagatggagaaaatcctccaagaacccacatgaacgaagggggctataataccccagttcaccatcctgtgattaaaagtgagaattcggtcatcaaagcgggagtgaggccagagtcacgggccagtgaggactacgtggcaccccccaaatacaagagcagcttgttgaaccgttaccttaatgactctttgagacatgtcatggccacgaacactaccatgatgggaaaaacaaggcaaagaaaccactcgggatcttttagctccaatgaatttgaggaagaattagtgtctccatcgtcatcagaaactgaaggcaactttgtctatcgcacagacactctggaaaatggatccaataagggtgaaagcgcagctaacagaaaaggaccaagcaaggatgacacgtattggaaggagatcaacgcagctatggccttaacaaatcttgcacagggaaaggacaaactgcagggaactaccagctgcatcatccagaagtcgtcccatatagcagaagtaaagactgtcaaagtgccgctggtgcagcagttt

SEQ ID NO: 183 - protein, 480 aa, Homo sapiens
MSFPQLGYPQYLSAAGPGAYGGERPGVLAAAAAAAAAASSGRPGAAELGGGAGAAAVTSVLGMYAAAGPYAGAPNYSAFLPYAADLSLFSQMGSQYELKDNPGVHPATFAAHTAPAYYPYGQFQYGDPGRPKNATRESTSTLKAWLNEHRKNPYPTKGEKIMLAIITKMTLTQVSTWFANARRRLKKENKVTWGARSKDQEDGALFGSDTEGDPEKAEDDEEIDLESIDIDKIDEHDGDQSNEDDEDKAEAPHAPAAPSALARDQGSPLAAADVLKPQDSPLGLAKEAPEPGSTRLLSPGAAAGGLQGAPHGKPKIWSLAETATSPDGAPKASPPPPAGHPGAHGPSAGAPLQHPAFLPSHGLYTCHIGKFSNWTNSAFLAQGSLLNMRSFLGVGAPHAAPHGPHLPAPPPPQPPVAIAPGALNGDKASVRSSPTLPERDLVPRPDSPAQQLKSPFQPVRDNSLAPQEGTPRILAALPSA

SEQ ID NO: 184 - DNA, 1440 bp, Homo sapiens
atgtccttcccgcagctgggctacccgcagtacctgagcgccgcggggccgggcgcctacggcggcgagcgcccgggggtgctggccgcggccgctgcggcggctgccgccgcctcgtcgggccgaccgggggccgcggagctgggcggcggggcaggcgcggctgcagtcacctcggtgctgggcatgtacgcggcggcggggccgtacgcgggcgcgcccaactacagcgccttcctgccctacgccgcggatctcagcctcttctcgcagatgggctcgcagtatgaactgaaggacaaccctggggtgcaccccgccaccttcgcagcccacacggcgccggcttattacccctacggccagttccaatacggggaccccgggcggcccaagaacgccacccgcgagagcaccagcacgctcaaggcctggctcaacgagcaccgcaagaatccctaccccaccaagggcgagaagatcatgctggccatcatcaccaagatgaccctcacgcaggtctccacctggttcgccaacgcgcgccggcgcctcaagaaggagaacaaggtgacatggggagcgcgcagcaaggaccaggaagatggagcgctcttcggcagcgacaccgagggcgacccggagaaggccgaggacgacgaggagatcgacctggaaagcatcgacattgacaagatcgacgagcacgatggcgaccagagcaacgaggatgacgaggacaaggccgaggctccgcacgcgcccgcagccccttctgctcttgcccgggaccaaggctcgccgctggcagcagccgacgttctcaagccccaggactcgcccttgggcctggcaaaggaggccccagagccgggcagcacgcgcctgctgagccccggcgctgcagcgggcggcctgcagggtgcgccgcacggcaagcccaagatctggtcgctggcggagacagccacgagccccgacggtgcgcccaaggcttcgccaccaccacccgcgggccaccccggcgcgcacgggccctccgccggggcgccgctgcaacaccccgccttcctgcctagccacggactgtacacctgccacatcggcaagttctccaactggaccaacagcgcattcctcgcacagggctccctgctcaacatgcgctccttcctgggcgttggcgctccccacgccgcgccccatggccctcaccttcctgcacctccaccaccgcagccgccggtcgctattgccccgggggcactcaatggagacaaggcctcggtccgcagcagccccacgctcccagagagagacctcgtccccaggccagattcgccggcacagcagttaaagtcgcccttccagccggtacgcgacaactctctggccccgcaggagggaacgccgcggatcctagcagccctcccgtccgcc

SEQ ID NO: 185 - protein, 471 aa, Homo sapiens
MSYPQGYLYQAPGSLALYSCPAYGASALAAPRSEELARSASGSAFSPYPGSAAFTAQAATGFGSPLQYSADAAAAAAGFPSYMGAPYDAHTTGMTGAISYHPYGSAAYPYQLNDPAYRKNATRDATATLKAWLNEHRKNPYPTKGEKIMLAIITKMTLTQVSTWFANARRRLKKENKMTWAPRNKSEDEDEDEGDATRSKDESPDKAQEGTETSAEDEGISLHVDSLTDHSCSAESDGEKLPCRAGDPLCESGSECKDKYDDLEDDEDDDEEGERGLAPPKPVTSSPLTGLEAPLLSPPPEAAPRGGRKTPQGSRTSPGAPPPASKPKLWSLAEIATSDLKQPSLGPGCGPPGLPAAAAPASTGAPPGGSPYPASPLLGRPLYYTSPFYGNYTNYGNLNAALQGQGLLRYNSAAAAPGEALHTAPKAASDAGKAGAHPLESHYRSPGGGYEPKKDASEGCTVVGGGVQPYL

SEQ ID NO: 186 - DNA, 1413 bp, Homo sapiens
atgtcctacccgcagggctacctgtaccaggcgcccggctcgctggcgctctactcgtgcccggcctacggcgcgtcggctttggcggctccgcgcagcgaggagctggcgcgctcggcgtcgggctcggcgttcagcccctacccgggctcggcggccttcacggcgcaggcggccaccggcttcgggagcccgctgcagtactcggccgacgccgccgccgccgccgccggcttcccgtcctacatgggcgcaccctacgacgcgcacaccaccggcatgaccggcgccatcagctaccacccgtacggcagcgcggcctacccgtaccagctcaacgaccccgcgtaccgcaagaacgccacgcgggacgccacggccactctcaaggcctggctcaacgagcaccgcaagaacccctaccccaccaagggcgagaagatcatgctagccatcatcaccaagatgaccctcacccaggtctccacctggttcgccaacgcgcgccggcgcctcaagaaggagaacaagatgacctgggccccgagaaacaaaagcgaagatgaggacgaggacgagggcgacgctaccagaagcaaggacgagagtcccgacaaggcgcaggagggcacggagacctcggcagaggacgaagggatcagcctgcacgtggactcgctcacggatcactcgtgctcggccgagtcggacggggagaagcttccgtgccgcgccggggaccccctgtgcgaatcgggctcggagtgcaaggacaagtatgacgacctggaggacgacgaggacgacgacgaggagggcgagcggggcctggcgccgcccaagcccgtgacctcgtcgccgcttaccggcttggaggcgccgctgctgagccccccgcccgaggccgcgccccgcggtggccgcaagacgccccagggcagccggacgtctccgggcgcgccgccccccgccagcaagcccaagctgtggtcgctggccgagatcgccacgtcggacctcaagcagccgagcctgggcccgggctgcgggccaccggggctgcccgcggccgccgcgccggcctcaaccggggcaccgccaggaggctcgccctaccctgcctcgccgctgctgggccgccccctctactacacgtcgcccttctacggcaactacacaaactacgggaacttgaacgcggcgctgcagggccagggtctcctgcggtacaactctgcggccgcggcccccggcgaggccctgcacaccgcgccaaaggcggccagcgacgcgggcaaggcgggcgcgcacccgctcgagtcccactaccggtccccgggcggcggctacgagcccaagaaagatgccagcgagggctgcaccgtggttggcgggggcgtccagccctaccta

SEQ ID NO: 187 - protein, 501 aa, Homo sapiens [sequence omitted]

SEQ ID NO: 188 - DNA, 1503 bp, Homo sapiens
atgtccttcccccagctgggataccaatacatccgcccgctttacccgtccgagcgcccgggggccgctggcggcagcggcggcagcgcgggggcccggggcggcctgggtgccggagcctcggagctgaacgcctcggggtccctgtccaacgtgctctcgtccgtgtacggggcgccctacgccgcggccgctgcggccgccgccgcccaaggctacggcgccttcctgccctacgccgcggagctgcccatcttcccgcagctgggcgcgcagtatgagctgaaggacagccccggggtgcagcatccggccgcggctgccgcgtttccgcacccgcaccccgccttctacccgtatggccagtaccagttcggggacccgtcccgtcccaagaacgccaccagggagagcaccagcacgctgaaggcctggctcaacgagcaccgcaagaacccctaccccaccaagggcgagaagatcatgctggccatcatcaccaagatgaccctcacccaggtgtccacctggttcgccaacgcgcgccggcgcctcaagaaggagaataagatgacttgggcgcctcgcagccgcactgacgaggagggaaacgcttatgggagcgagcgcgaggaggaagacgaagaggaggacgaggaggacggcaaacgcgagctagagctggaggaggaggagctcgggggggaggaggaggacacggggggcgagggcctggctgacgacgacgaggacgaggagatcgatttggagaacttagacggcgcggccaccgagcctgagctgtccctggctggggcggcgcgcagggatggcgacctaggcctgggacccatttcggactccaaaaatagcgactcggaagatagctctgagggcttagaggaccggccactaccggtcctgagtctggctccagcgccaccaccagtggccgtggcctcgccgtctctgccgtcgccccccgtgagcctggacccctgcgctcccgcaccagcccccgcctccgccctgcagaagcccaagatctggtccctcgcggagactgccacaagcccggacaacccgcgccgctcgcctcccggcgcgggggggtctccaccgggggcagcggtcgcgccttccgccctgcagctctctccggccgccgccgccgccgccgctcacagactggtctcagcgccgctgggcaagttcccggcttggaccaaccggccgtttccaggcccaccgcccggcccccgcccgcacccgctctccctgctgggctctgcccctccgcacctgctgggacttcccggagccgcgggccacccggctgccgccgccgccttcgctcggccagcggagcccgaaggcggaacagatcgctgtagtgccttggaagtggagaaaaagttactcaagacagctttccagcccgtgcccaggcggccccagaaccatctggacgccgccctggtcttatcggctctctcctcatcc

SEQ ID NO: 189 - protein, 519 aa, Homo sapiens
MSYPQFGYPYSSAPQFLMATNSLSTCCESGGRTLADSGPAASAQAPVYCPVYESRLLATARHELNSAAALGVYGGPYGGSQGYGNYVTYGSEASAFYSLNSFDSKDGSGSAHGGLAPATAAYYPYEPALGQYPYDRYGTMDSGTRRKNATRETTSTLKAWLQEHRKNPYPTKGEKIMLAIITKMTLTQVSTWFANARRRLKKENKMTWPPRNKCADEKRPYAEGEEEEGGEEEAREEPLKSSKNAEPVGKEEKELELSDLDDFDPLEAEPPACELKPPFHSLDGGLERVPAAPDGPVKEASGALRMSLAAGGGAALDEDLERARSCLRSAAAGPEPLPGAEGGPQVCEAKLGFVPAGASAGLEAKPRIWSLAHTATAAAAAATSLSQTEFPSCMLKRQGPAAPAAVSSAPATSPSVALPHSGALDRHQDSPVTSLRNWVDGVFHDPILRHSTLNQAWATAKGALLDPGPLGRSLGAGANVLTAPLARAFPPAVPQDAPAAGAARELLALPKAGGKPFCA

SEQ ID NO: 190 - DNA, 1557 bp, Homo sapiens
atgtcctacccgcagtttggatacccctactcctcggctccccagttcttgatggccaccaactccctgagcacgtgctgcgagtccggaggccgcacgctggcggactccgggcccgccgcctcggcccaggcgccggtctactgcccggtctacgagagccggctgctggccaccgcgcgccacgagctcaactcggccgcggcgctgggcgtctatgggggtccctatggcggatcgcagggctatggcaactacgtgacctacggctcggaggcgtccgccttctactcgctgaacagctttgattccaaggatggttcgggatctgcgcatgggggcctggcaccagccactgccgcctactacccttacgagccagctctgggccagtacccctatgacaggtatggaaccatggacagcggcacgcggcgcaagaacgccacgcgcgagaccaccagcacgctcaaggcctggctgcaggagcaccgcaagaacccctaccccaccaagggcgagaagatcatgctggccatcatcaccaagatgaccctcacacaggtctccacctggttcgccaacgcgcgccggcgcctcaagaaggagaacaagatgacgtggccgccgcggaacaagtgcgcagacgagaagcggccctacgcggagggcgaggaggaggaggggggcgaggaggaggcgcgggaggagcccctcaagagctccaagaacgcagagcccgtgggcaaagaggagaaggagctggagcttagtgacttggacgacttcgacccgctggaagcagagccgccggcgtgcgagctgaagccgcccttccactccctggacggcggtctggagcgcgtccccgccgcgcccgacggcccggtcaaggaggcctcaggcgcgctccggatgtctctggccgcgggtggcggagctgctctggacgaggacctggagagggcccggagctgtctccgcagcgcggcggccgggccggagccactgccgggcgcagagggcggccctcaggtctgcgaggccaagctggggtttgtgccggcgggggcgtcggcaggcctggaggctaagccgcgcatctggtccctggcccacacagccaccgccgccgccgccgccgccacctccctgagccagactgagtttccgtcgtgcatgctcaagcgccaaggtcccgcggcccctgcggctgtgtcctccgcgcccgccacgtccccgtctgtggcccttccccactctggcgccctggacaggcaccaggactccccggtaaccagtctcagaaactgggtggacggggtcttccacgaccccatcctcaggcacagcactttgaaccaggcctgggccaccgccaagggcgccctcctggaccccgggcctctgggacgctcgctgggggcgggcgcgaacgtgctgactgcacccctggcccgcgcctttccgcctgccgtgccccaggacgccccagctgcaggcgccgccagggagctgctcgccctgcccaaggccggcggcaaacccttctgcgcc

SEQ ID NO: 191 - protein, 483 aa, Homo sapiens
MSYPQGYLYQPSASLALYSCPAYSTSVISGPRTDELGRSSSGSAFSPYAGSTAFTAPSPGYNSHLQYGADPAAAAAAAFSSYVGSPYDHTPGMAGSLGYHPYAAPLGSYPYGDPAYRKNATRDATATLKAWLNEHRKNPYPTKGEKIMLAIITKMTLTQVSTWFANARRRLKKENKMTWTPRNRSEDEEEEENIDLEKNDEDEPQKPEDKGDPEGPEAGGAEQKAASGCERLQGPPTPAGKETEGSLSDSDFKEPPSEGRLDALQGPPRTGGPSPAGPAAARLAEDPAPHYPAGAPAPGPHPAAGEVPPGPGGPSVIHSPPPPPPPAVLAKPKLWSLAEIATSSDKVKDGGGGNEGSPCPPCPGPIAGQALGGSRASPAPAPSRSPSAQCPFPGGTVLSRPLYYTAPFYPGYTNYGSFGHLHGHPGPGPGPTTGPGSHFNGLNQTVLNRADALAKDPKMLRSQSQLDLCKDSPYELKKGMSDI

SEQ ID NO: 192 - DNA, 1449 bp, Homo sapiens
atgtcctatccgcagggctacttgtaccagccgtccgcctcgctggcgctctactcgtgcccggcgtacagcaccagcgtcatttcggggccccgcacggatgagctcggccgctcttcttcgggctccgcgttctcgccctacgctggctcgactgccttcacggcgccctcgccgggctacaactcgcacctccagtacggcgccgaccccgcggccgccgccgccgccgccttctcctcgtacgtgggctctccctacgaccacacacccggcatggcgggctccttggggtaccatccttacgcggcgcccctgggatcgtacccttacggggacccagcgtaccggaagaacgccacaagggacgccacggctaccctcaaggcctggctcaacgagcaccgcaagaacccctaccccaccaagggcgagaagatcatgctggccatcatcaccaagatgaccctcacccaggtgtccacctggttcgccaacgcgcgccggcgcctcaagaaagagaataaaatgacgtggacgccgcggaaccgcagcgaggacgaggaagaggaggagaacattgacctggagaagaacgacgaggacgagccccagaagcccgaggacaagggcgaccccgagggccccgaagcaggaggagctgagcagaaggcggcttcgggctgcgaacggcttcagggaccacccacccctgcaggcaaggagacggagggcagcctcagcgactcggattttaaggagccgccctcggagggccgcctcgacgcgctgcagggccccccccgcaccggcgggccctccccggctgggccagcggcggcgcggctggcggaggacccggcccctcactaccccgccggagcgccggcgcccggcccgcatccagccgcgggcgaggtgcctccgggtcccggcgggccctcggttatccattcgccgcctccgccgccgcctcctgcggtgctcgccaagcccaaactgtggtctttggcagagatcgccacatcgtcggacaaggtcaaggacgggggcggcgggaacgagggctctccatgcccaccgtgtcccgggcccatagccgggcaagccctaggaggcagccgggcgtcgccggccccggcgccgtcacgctcgccctcggcgcagtgtccttttccaggcgggacggtgctgtcccggcctctctactacaccgcgcccttctatcccggctacacgaactatggctccttcggacaccttcatggccacccggggcccgggccaggccccacaaccggtccggggtctcatttcaatggattaaaccagaccgtgttgaaccgagcggacgctttggctaaagacccgaaaatgttgcggagccagtctcagctagacctgtgcaaagactctccctatgaattgaagaaaggtatgtccgacatt

SEQ ID NO: 193 - protein, 446 aa, Homo sapiens
MSFPHFGHPYRGASQFLASASSSTTCCESTQRSVSDVASGSTPAPALCCAPYDSRLLGSARPELGAALGIYGAPYAAAAAAQSYPGYLPYSPEPPSLYGALNPQYEFKEAAGSFTSSLAQPGAYYPYERTLGQYQYERYGAVELSGAGRRKNATRETTSTLKAWLNEHRKNPYPTKGEKIMLAIITKMTLTQVSTWFANARRRLKKENKMTWAPKNKGGEERKAEGGEEDSLGCLTADTKEVTASQEARGLRLSDLEDLEEEEEEEEEAEDEEVVATAGDRLTEFRKGAQSLPGPCAAAREGRLERRECGLAAPRFSFNDPSGSEEADFLSAETGSPRLTMHYPCLEKPRIWSLAHTATASAVEGAPPARPRPRSPECRMIPGQPPASARRLSVPRDSACDESSCIPKAFGNPKFALQGLPLNCAPCPRRSEPVVQCQYPSGAEAG

SEQ ID NO: 194 - DNA, 1338 bp, Homo sapiens
atgtccttcccacactttggacacccgtaccgcggcgcttcccagtttctggcgtcggcaagttccagcaccacatgctgcgaatctacccaacgctctgtctcagatgtggcatcaggctccaccccagcgcccgctctctgctgcgcaccctacgatagtcgactgctgggcagtgcgcgaccggagctgggcgccgccttgggcatctatggagcaccctatgcggccgctgcagctgcccagagctaccctggctacctgccctatagcccagagcccccctcactgtatggggcactgaatccacagtatgaatttaaggaggctgcagggagttttacatccagcctggcacaaccaggagcctattatccctatgagcggactctggggcagtaccaatatgaacggtatggcgcagtggaattgagtggcgccggtcgccgaaagaacgcgacccgggagaccaccagtacactcaaggcctggctcaacgagcaccgcaaaaacccctaccccactaagggtgagaagatcatgctggccatcatcaccaagatgaccctcacccaggtgtccacctggttcgccaacgcacgccggcgcctcaagaaagagaacaaaatgacatgggcgcccaagaacaaaggtggggaggagaggaaggcagagggaggagaggaggactcactaggctgcctaactgctgacaccaaagaagttactgctagccaggaggcccgggggctccggctgagtgacctggaagacctggaggaagaggaggaggaggaggaggaagctgaagacgaggaggtagtggccacagctggggacaggctgacggagttccgaaagggcgcgcagtcactgcctgggccgtgcgctgcagctcgagagggccgattggagcgcagggagtgcggcctggctgcgccccgcttctccttcaatgacccttccggatcggaagaagctgacttcctctcggcggagacaggcagccctaggttgaccatgcactacccatgcttggagaaaccgcgcatctggtctctggcgcacaccgcgacagccagcgctgttgaaggtgcacccccagcccggcctaggccacgaagtcctgagtgccgtatgattcctggacagcctcctgcctctgcccggcgactctcagtccccagagactccgcgtgcgacgagtcttcctgcatacccaaagcctttggaaaccccaagtttgccctgcagggactaccgctgaactgtgcgccgtgcccgcggaggagcgagcctgtagtgcagtgccagtacccgtctggagcagaagcaggt

SEQ ID NO: 195 - protein, 201 aa, Homo sapiens
MSFATLRPAPPGRYLYPEVSPLSEDEDRGSDSSGSDEKPCRVHAARCGLQGARRRAGGRRAGGGGPGGRPGREPRQRHTANARERDRTNSVNTAFTALRTLIPTEPADRKLSKIETLRLASSYISHLGNVLLAGEACGDGQPCHSGPAFFHAARAGSPPPPPPPPPARDGENTQPKQICTFCLSNQRKLSKDRDRKTAIRS

SEQ ID NO: 196 - DNA, 603 bp, Homo sapiens
atgtccttcgccacgctgcgcccggcgccgccgggccgctacctgtaccccgaggtgagcccgctgtcggaggacgaggaccgcggcagcgacagctcgggctccgacgagaaaccctgtcgcgtgcacgcggcgcgctgcggcctccagggcgcccggcggagggcggggggccggcgggccgggggcggggggccagggggccggccaggccgtgagccccggcagcggcacacggcgaacgcgcgcgagcgagaccgcaccaacagcgtgaacacggccttcacggcgctgcgcacgctgatccccaccgagcccgccgaccgcaagctctccaagattgagacgctgcgcctggcctccagctacatctcgcacctgggcaacgtgctgctggcgggcgaggcctgcggcgacggacagccctgccactccgggcccgccttcttccacgcggcgcgcgccggcagccccccgccgccgcccccgccgcctcccgcccgcgacggcgagaacacccagcccaaacagatctgcaccttctgcctcagcaaccagagaaagttgagcaaggaccgcgacagaaagacagcgattcgcagt

SEQ ID NO: 197 - protein, 480 aa, Homo sapiens
MASDSIFESFPSYPQCFMRECILGMNPSRDVHDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRRHRQKLDDQTKPGSLSFSERLSELEQLRRTAMRVSPHHPAPTPNPRASLNHSTAFNPQPQSQMQDTRQIQPSPPWSYDQSYQYLGSIASPSVHPATPISPGRASGMTTLSAELSSRLSTAPDLTAFSDPRQFPALPSISDPRMHYPGAFTYSPTPVTSGIGIGMSAMGSATRYHTYLPPPYPGSSQAQGGPFQASSPSYHLYYGASAGSYQFSMVGGERSPPRILPPCTNASTGSALLNPSLPNQSDVVEAEGSHSNSPTNMAPSARLEEAVWRPY

SEQ ID NO: 198 - DNA, 1440 bp, Homo sapiens
atggcttcagacagcatatttgagtcatttccttcgtacccacagtgcttcatgagagaatgcatacttggaatgaatccttctagagacgtccacgatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggatacaaggcagatccaaccatccccaccgtggtcctacgatcagtcctaccaatacctgggatccattgcctctccttctgtgcacccagcaacgcccatttcacctggacgtgccagcggcatgacaaccctctctgcagaactttccagtcgactctcaacggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgggctcggccacgcgctaccacacctacctgccgccgccctaccccggctcgtcgcaagcgcagggaggcccgttccaagccagctcgccctcctaccacctgtactacggcgcctcggccggctcctaccagttctccatggtgggcggcgagcgctcgccgccgcgcatcctgccgccctgcaccaacgcctccaccggctccgcgctgctcaaccccagcctcccgaaccagagcgacgtggtggaggccgagggcagccacagcaactcccccaccaacatggcgccctccgcgcgcctggaggaggccgtgtggaggccctac

SEQ ID NO: 199 - protein, 589 aa, Homo sapiens
MLHSPHKQPQNHKCGANFLQEDSKKSLVFKWLISAGHYQPPRPTESFKAASSIYNRGYKFYLKKKGGTMASNSLFSTVTPCQQNFFWDPSTSRRFSPPSSSLQPGKMSDVSPVVAAQQQQQQQQQQQQQQQQQQQQQQQEAAAAAAAAAAAAAAAAAVPRLRPPHDNRTMVEIIADHPAELVRTDSPNFLCSVLPSHWRCNKTLPVAFKVVALGEVPDGTVVTVMAGNDENYSAELRNASAVMKNQVARFNDLRFVGRSGRGKSFTLTITVFTNPPQVATYHRAIKVTVDGPREPRRHRQKLDDSKPSLFSDRLSDLGRIPHPSMRVGVPPQNPRPSLNSAPSPFNPQGQSQITDPRQAQSSPPWSYDQSYPSYLSQMTSPSIHSTTPLSSTRGTGLPAITDVPRRISDDDTATSDFCLWPSTLSKKSQAGASELGPFSDPRQFPSISSLTESRFSNPRMHYPATFTYTPPVTSGMSLGMSATTHYHTYLPPPYPGSSQSQSGPFQTSSTPYLYYGTSSGSYQFPMVPGGDRSPSRMLPPCTTTSNGSTLLNPNLPNQNDGVDADGSHSSSPTVLNSSGRMDESVWRPY

SEQ ID NO: 200 - DNA, 1767 bp, Homo sapiens
atgcttcattcgcctcacaaacaaccacagaaccacaagtgcggtgcaaactttctccaggaggacagcaagaagtctctggtttttaaatggttaatctccgcaggtcactaccagccaccgagaccaacagagtcatttaaggctgcaagcagtatttacaacagagggtacaagttctatctgaaaaaaaaaggagggactatggcatcaaacagcctcttcagcacagtgacaccatgtcagcaaaacttcttttgggatccgagcaccagccggcgcttcagccccccctccagcagcctgcagcccggcaaaatgagcgacgtgagcccggtggtggctgcgcaacagcagcagcaacagcagcagcagcaacagcagcagcagcagcagcaacagcagcagcagcagcaggaggcggcggcggcggctgcggcggcggcggcggctgcggcggcggcagctgcagtgccccggttgcggccgccccacgacaaccgcaccatggtggagatcatcgccgaccacccggccgaactcgtccgcaccgacagccccaacttcctgtgctcggtgctgccctcgcactggcgctgcaacaagaccctgcccgtggccttcaaggtggtagccctcggagaggtaccagatgggactgtggttactgtcatggcgggtaacgatgaaaattattctgctgagctccggaatgcctctgctgttatgaaaaaccaagtagcaaggttcaacgatctgagatttgtgggccggagtggacgaggcaagagtttcaccttgaccataaccgtcttcacaaatcctccccaagtagctacctatcacagagcaattaaagttacagtagatggacctcgggaacccagaaggcacagacagaagcttgatgactctaaacctagtttgttctctgaccgcctcagtgatttagggcgcattcctcatcccagtatgagagtaggtgtcccgcctcagaacccacggccctccctgaactctgcaccaagtccttttaatccacaaggacagagtcagattacagaccccaggcaggcacagtcttccccgccgtggtcctatgaccagtcttacccctcctacctgagccagatgacgtccccgtccatccactctaccaccccgctgtcttccacacggggcactgggcttcctgccatcaccgatgtgcctaggcgcatttcagatgatgacactgccacctctgacttctgcctctggccttccactctcagtaagaagagccaggcaggtgcttcagaactgggccctttttcagaccccaggcagttcccaagcatttcatccctcactgagagccgcttctccaacccacgaatgcactatccagccacctttacttacaccccgccagtcacctcaggcatgtccctcggtatgtccgccaccactcactaccacacctacctgccaccaccctaccccggctcttcccaaagccagagtggacccttccagaccagcagcactccatatctctactatggcacttcgtcaggatcctatcagtttcccatggtgccggggggagaccggtctccttccagaatgcttccgccatgcaccaccacctcgaatggcagcacgctattaaatccaaatttgcctaaccagaatgatggtgttgacgctgatggaagccacagcagttccccaactgttttgaattctagtggcagaatggatgaatctgtttggcgaccatat

SEQ ID NO: 201 - protein, 429 aa, Homo sapiens
MASNSIFDSFPTYSPTFIRDPSTSRRFTPPSPAFPCGGGGGKMGENSGALSAQAAVGPGGRARPEVRSMVDVLADHAGELVRTDSPNFLCSVLPSHWRCNKTLPVAFKVVALGDVPDGTVVTVMAGNDENYSAELRNASAVMKNQVARFNDLRFVGRSGRGKSFTLTITVFTNPTQVATYHRAIKVTVDGPREPRRHRQKLEDQTKPFPDRFGDLERLRMRVTPSTPSPRGSLSTTSHFSSQPQTPIQGTSELNPFSDPRQFDRSFPTLPTLTESRFPDPRMHYPGAMSAAFPYSATPSGTSISSLSVAGMPATSRFHHTYLPPPYPGAPQNQSGPFQANPSPYHLYYGTSSGSYQFSMVAGSSSGGDRSPTRMLASCTSSAASVAAGNLMNPSLGGQSDGVEADGSHSNSPTALSTPGRMDEAVWRPY

SEQ ID NO: 202 - DNA, 1287 bp, Homo sapiens
atggcatcgaacagcatcttcgactccttcccgacctactcgccgaccttcatccgcgacccaagcaccagccgccgcttcacacctccctccccggccttcccctgcggcggcggcggcggcaagatgggcgagaacagcggcgcgctgagcgcgcaggcggccgtggggcccggagggcgcgcccggcccgaggtgcgctcgatggtggacgtgctggcggaccacgcaggcgagctcgtgcgcaccgacagccccaacttcctctgctccgtgctgccctcgcactggcgctgcaacaagacgctgcccgtcgccttcaaggtggtggcattgggggacgtgccggatggtacggtggtgactgtgatggcaggcaatgacgagaactactccgctgagctgcgcaatgcctcggccgtcatgaagaaccaggtggccaggttcaacgaccttcgcttcgtgggccgcagtgggcgagggaagagtttcaccctgaccatcactgtgttcaccaaccccacccaagtggcgacctaccaccgagccatcaaggtgaccgtggacggaccccgggagcccagacggcaccggcagaagctggaggaccagaccaagccgttccctgaccgctttggggacctggaacggctgcgcatgcgggtgacaccgagcacacccagcccccgaggctcactcagcaccacaagccacttcagcagccagccccagaccccaatccaaggcacctcggaactgaacccattctccgacccccgccagtttgaccgctccttccccacgctgccaaccctcacggagagccgcttcccagaccccaggatgcattatcccggggccatgtcagctgccttcccctacagcgccacgccctcgggcacgagcatcagcagcctcagcgtggcgggcatgccggccaccagccgcttccaccatacctacctcccgccaccctacccgggggccccgcagaaccagagcgggcccttccaggccaacccgtccccctaccacctctactacgggacatcctctggctcctaccagttctccatggtggccggcagcagcagtgggggcgaccgctcacctacccgcatgctggcctcttgcaccagcagcgctgcctctgtcgccgccggcaacctcatgaaccccagcctgggcggccagagtgatggcgtggaggccgacggcagccacagcaactcacccacggccctgagcacgccaggccgcatggatgaggccgtgtggcggccctac

SEQ ID NO: 203 - protein, 341 aa, Homo sapiens
MEPAFGEVNQLGGVFVNGRPLPNAIRLRIVELAQLGIRPCDISRQLRVSHGCVSKILARYNETGSILPGAIGGSKPRVTTPTVVKHIRTYKQRDPGIFAWEIRDRLLADGVCDKYNVPSVSSISRILRNKIGNLAQQGHYDSYKQHQPTPQPALPYNHIYSYPSPITAAAAKVPTPPGVPAIPGSVAMPRTWPSSHSVTDILGIRSITDQVSDSSPYHSPKVEEWSSLGRNNFPAAAPHAVNGLEKGALEQEAKYGQAPNGLPAVGSFVSASSMAPYPTPAQVSPYMTYSAAPSGYVAGHGWQHAGGTSLSPHNCDIPASLAFKGMQAAREGSHSVTASAL

SEQ ID NO: 204 - DNA, 4166 bp, Homo sapiens
agcccagcccacgttgctgcttagattgaaatgcagaactcaagcctctttcatcggggcacagacttccttttacttcttccttttgccctctcgcctcctcctcctgggaagaagcggaggcgccggcggtcggccgggatagcaacaggccgggccactgaggcggtgcggaaagtttctgtctgggagtgcggaactggggccgggttggtgtactgctcggagcaatggagccagccttcggggaggtgaaccagctgggaggagtgttcgtgaacgggaggccgctgcccaacgccatccggcttcgcatcgtggaactggcccaactgggcatccgaccgtgtgacatcagccgccagctacgggtctcgcacggctgcgtcagcaagatcctggcgcgatacaacgagacgggctcgatcttgccaggagccatcgggggcagcaagccccgggtcactacccccaccgtggtgaaacacatccggacctacaagcagagagaccccggcatcttcgcctgggagatccgggaccgcctgctggcggacggcgtgtgcgacaagtacaatgtgccctccgtgagctccatcagccgcattctgcgcaacaagatcggcaacttggcccagcagggtcattacgactcatacaagcagcaccagccgacgccgcagccagcgctgccctacaaccacatctactcgtaccccagccctatcacggcggcggccgccaaggtgcccacgccacccggggtgcctgccatccccggttcggtggccatgccgcgcacctggccctcctcgcactccgtcaccgacatcctgggcatccgctccatcaccgaccaagtgagcgacagctccccctaccacagccccaaggtggaggagtggagcagcctgggccgcaacaacttccccgccgccgccccgcacgcggtgaacgggttggagaagggagccctggagcaggaagccaagtacggtcaggcaccaaatggtctcccagctgtgggcagttttgtgtcagcatccagcatggctccttaccctaccccagcccaagtgtcgccttacatgacctacagtgctgctccttctggttatgttgctggacatgggtggcaacatgctgggggcacctcattgtctccccacaactgtgacattccggcatcgctggcgttcaagggaatgcaggcagccagagaaggtagtcattctgtcacggcttccgcgctctgatgggaaattccgtctccagcagcttcacccgggtctccctgtctcagcacctcctcccccaattcccaggtctcacatcccacccctcctgccctccaacccttctgccttgaaagctggctgtacggactcacatcctttgtgctaatgacacttacatatttcttgccataacttttctcttgcagaaaaactgacatgactttaggatttaaaaacaagagcaacaataagcattgaatgagacatttgtgttgcccacatactgtcttaacataacaaagaaacctacacccctcaaagggtttaaggaactttacaaactagtctttggtaaaaccacatgtgtatatttattctaaatcaacctgaacttttgaaatgtgcaattgttgagattttgcaaaatcaataaaggaaaatacttatagaaaaaattatgctacaccctctaatcaaatatggtaaccaagtaagctttaattcatcattaggaaacaaatcaataagtgacttgtttgagtgatcctttgtttaagacatgacctattttgttgaaaaatatatgtagaacccaagcaatatctgaatctagctctccctggtgttttgacttggttccaaatacaataatgtttatattttctattagtttgtaaatacggactctggatggtgcatttgtgtcttcattccataagatattcccctcccctcagccccaccccctctctatttttttctttcttttttgcaaaggtgactttctggcaacgtctttgtctctgtttggtggtgggctgctcgggctcctggacctggacttgcccccaaattttgtgtatgcagtgaaggcttcaacatctcatgaaggacactttatttctacagcagaggacacgaaaaacagataaaacaagccagtctcccattttgtacctaatcaaacaacacacatgctaagcatataaagacaagagggtggaaaatatctgaacaagaaggctctaaaggaagtcacttagaaacttaagtttaatgtgaaatgttttgcaaagatgcttaaaatgaactttgtgttaagaaaaccactgtgaaactaaattgtcctattattgttggcttacctgtgtgttcagcaatctcagccccaaataatgttgtaatttaaagaaaatggaaaattctgctctaatgaatgtaacaatggcttgctgtgaagtttacattgttgtacagaagcatgtttcgcatgtaggtaaactggtggtggtactagaaatacaatgttatttaattttaacaaattccctttattcatttctgaaattacaggacacagtttaactcataaacctttctagaccaatttatttttcactttaatgttaataacagttgtggagtatatgtgtgtgtgagcatgtgagtatgtgttgtattttaaaacaattgattttctggggcaaaattctacagtttttaatcccttctgtttaggaagttcttcctgtttggcaatataggcttaaaaatatgtttttaggacattggtacaattcagctgttggaaaattaatatattgagggttttttggtactaattctgtgcaataactaaaagagcacctcactggatatggatgttgaagatggattccctaggtgattttaatttcttccggtctgtgctgtgcacagtctacatggcaatgcggttccaccacatcggtttcgtggcttcgtttaaaactcagatggctagattagttaggttttcaaatcactaggatgtaaacagtaagcagatttctgacacacaaattatgttagagtgactgcttttttcagacagcagatatcttatagagagctttgaactgcatttatttctaaagcaaccgaaattcagtgctacaaatagaggattataacttcaggagaagaataagcagaaggagcagatgaactctcagggccatagtcttcctttgatcttgtaaaacttccattgacatctggagttcccagtctggtgagaaaatagactataaactgaatggaacaaagatccaatccaatattttggtggagacttctttaaaaccataccatacagggactctcctgtcatctgaaaaactgatgtaaggtacagaactattctttatcaaatgtttttaggtggctgttagggggctttaaaaaatattacttgcttgtgtggaaatgcaaataatgttattttctttatctaaattaagaaatctcttgttattgtgctatttataatttttttctggttcttgtattttaaaaaatctaatattaatggtattgaagtttccttttctccctctaggtcttaacagtgaattcacatggagtaatttttaaaagatatcagatacaatttgctattcaaagaaaattatgatttaaagccactttttaaaatacgagaaggaaaataggatggattaaagggttaacttttaaagattattattggttaatgttgacatatttcctctatctcatagatggtaaaagtgttgcttttaaactggcaaatgcactcttcagaaatccttttctatctgatccacatggagaggttaaaggttcaatttcatgacctctatgcaggcagcgctctcattggatgtaagaatattacctgcaaggatagaatgcagttgtgcaacagagacacattcttatttcttttttttcacaattttgttttgtttttaatgacccttttattgaatattggactgaaatataaattttaaaaaacacgttggaaaggatgtacaacagaaggctatgtatgtatatacagtatgtcaaaagccttttatttttatacttcaaatgctctaaattaataaaaagtaataatta

SEQ ID NO: 205 - protein, 333 aa, Homo sapiens
MAVRGANTLTSFSIQAILNKKEERGGLAAPEGRPAPGGTAASVAAAPAVCCWRLFGERDAGALGGAEDSLLASPAGTRTAAGRTAESPEGWDSDSALSEENESRRRCADARGASGAGLAGGSLSLGQPVCELAASKDLEEEAAGRSDSEMSASVSGDRSPRTEDDGVGPRGAHVSALCSGAGGGGGSGPAGVAEEEEEPAAPKPRKKRSRAAFSHAQVFELERRFNHQRYLSGPERADLAASLKLTETQVKIWFQNRRYKTKRRQMAADLLASAPAAKKVAVKVLVRDDQRQYLPGEVLRPPSLLPLQPSYYYPYYCLPGWALSTCAAAAGTQ

SEQ ID NO: 206 - DNA, 2259 bp, Homo sapiens
actcgcgctgcggccgccggcgctctctgtcccgctcggagctgctcggcgccccagctgcccgccccgccggccgctcctgcccgcggcgcagatggctgtgcgcggcgccaacaccttgacgtccttctccatccaggcgatcctcaacaagaaagaggagcgcggcgggctggccgcgccagaggggcgcccggcgcccgggggcacagcggcatcggtggccgcggctcccgctgtctgctgttggcggctctttggggagagggacgcgggcgcgttggggggcgccgaggactctctgctggcgtctcctgccggtaccagaacagctgcggggcggactgcggagagcccggaaggctgggactcggactccgcgctcagcgaggagaacgagagcaggcggcgctgcgcggacgcgcggggggccagcggggccggccttgcggggggatccttgagcctcggccagccggtctgtgagctggccgcttccaaagacctagaggaggaagccgcgggccggagcgacagcgagatgtccgccagcgtctcaggcgaccgcagcccaaggaccgaggacgacggtgttggccccagaggtgcacacgtgtccgcgctgtgcagcggggccggcggcgggggcggcagcgggccggcaggcgtcgcggaggaggaggaggagccggcggcgcccaagccacgcaagaagcgctcgcgggccgctttctcccacgcgcaggtcttcgagctggagcgccgctttaaccaccagcgctacctgtccgggcccgagcgcgcagacctggccgcgtcgctgaagctcaccgagacgcaggtgaaaatctggttccagaaccgtcgctacaagacaaagcgccggcagatggcagccgacctgctggcctcggcgcccgccgccaagaaggtggccgtaaaggtgctggtgcgcgacgaccagagacaatacctgcccggcgaagtgctgcggccaccctcgcttctgccactgcagccctcctactattacccgtactactgcctcccaggctgggcgctctccacctgcgcagctgccgcaggcacccagtgaacccgcttgggctgaggcagcgagtgattcccgcgctccggctccggaccggcgctgacagctgtaggctgtagcctgcacggggcgccccgccaaggaggcacctggaggtgaaacccagctccagctcccgttagccaggacttgtcccctggcagctgggctgagtctgccctgagggggcgcctttttctaatttgaacagaggcaccctatggcctaggggccctgatcgcccacctgcctggaagcccctgggctctatttattatcatgacaatgttggaattaaattttgattcgaatatgtctgcctgggggtggggttttccctgagcggcaactcctggagaccacatagcctgaatcctcagaatttcaggcctgctgggagctttctgcactaggccacactagttcatggtatccatgctaccaatctatgtgtatctacatatcttttatttttggaaattgcatttgtaaccaaggggtgcgaaaccctggcagtcccaggcagcaccaggccaggggttgatttgaaacgtgaaggattgggttttcaggccctctgctccacccctcctgtgtgtcagagctagggtgggggtgcccgattcgggtgctgaatgtaaggaggggagcctccaagtgtggtgcaagccgggggtctccacatcttccttctctgaagtccaggtacctgcacaagcaggaagcgcctgggagtcccggaaggaggagagcgcacacccaggcagccctctgcggaaactttccttggtttctttttatttgtgtaaaggaggttaagacgtgtcgcacttttcagttgtttgtattcaaatgacgattatttttctactcaatgtgaatatccctggccagcctttccacggcgcccaccgcagtgccgctgcctggccctcagtgtctaccttctgccctctgcgactccagtgctctggcccgggactcccctatccgcccctcacttacccttaaacaggtgatcccacctgtcttgtcaacctcgccgcttttcgcctccttaatggcactgtgcactcaactagagtattaactgtaaaaagatttgtgaagtttggaagctctattcgctgtattttttctttaatttataaacttttagtttaacatgc

SEQ ID NO: 207 - protein, 350 aa, Homo sapiens
MMFSGFNADYEASSSRCSSASPAGDSLSYYHSPADSFSSMGSPVNAQDFCTDLAVSSANFIPTVTAISTSPDLQWLVQPALVSSVAPSQTRAPHPFGVPAPSAGAYSRAGVVKTMTGGRAQSIGRRGKVEQLSPEEEEKRRIRRERNKMAAAKCRNRRRELTDTLQAETDQLEDEKSALQTEIANLLKEKEKLEFILAAHRPACKIPDDLGFPEEMSVASLDLTGGLPEVATPESEEAFTLPLLNDPEPKPSVEPVKSISSMELKTEPFDDFLFPASSRPSGSETARSVPDMDLSGSFYAADWEPLHSGSLGMGPMATELEPLCTPVVTCTPSCTAYTSSFVFTYPEADS

SEQ ID NO: 208 - DNA, 2104 bp, Homo sapiens
aaccgcatctgcagcgagcatctgagaagccaagactgagccggcggccgcggcgcagcgaacgagcagtgaccgtgctcctacccagctctgctccacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggacttctgcacggacctggccgtctccagtgccaacttcattcccacggtcactgccatctcgaccagtccggacctgcagtggctggtgcagcccgccctcgtctcctccgtggccccatcgcagaccagagcccctcaccctttcggagtccccgccccctccgctggggcttactccagggctggcgttgtgaagaccatgacaggaggccgagcgcagagcattggcaggaggggcaaggtggaacagttatctccagaagaagaagagaaaaggagaatccgaagggaaaggaataagatggctgcagccaaatgccgcaaccggaggagggagctgactgatacactccaagcggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtggcttcccttgatctgactgggggcctgccagaggttgccaccccggagtctgaggaggccttcaccctgcctctcctcaatgaccctgagcccaagccctcagtggaacctgtcaagagcatcagcagcatggagctgaagaccgagccctttgatgacttcctgttcccagcatcatccaggcccagtggctctgagacagcccgctccgtgccagacatggacctatctgggtccttctatgcagcagactgggagcctctgcacagtggctccctggggatggggcccatggccacagagctggagcccctgtgcactccggtggtcacctgtactcccagctgcactgcttacacgtcttccttcgtcttcacctaccccgaggctgactccttccccagctgtgcagctgcccaccgcaagggcagcagcagcaatgagccttcctctgactcgctcagctcacccacgctgctggccctgtgagggggcagggaaggggaggcagccggcacccacaagtgccactgcccgagctggtgcattacagagaggagaaacacatcttccctagagggttcctgtagacctagggaggaccttatctgtgcgtgaaacacaccaggctgtgggcctcaaggacttgaaagcatccatgtgtggactcaagtccttacctcttccggagatgtagcaaaacgcatggagtgtgtattgttcccagtgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcga

SEQ ID NO: 209 - protein, 302 aa, Homo sapiens
MFQAFPGDYDSGSRCSSSPSAESQYLSSVDSFGSPPTAAASQECAGLGEMPGSFVPTVTAITTSQDLQWLVQPTLISSMAQSQGQPLASQPPVVDPYDMPGTSYSTPGMSGYSSGGASGSGGPSTSGTTSGPGPARPARARPRRPREETETDQLEEEKAELESEIAELQKEKERLEFVLVAHKPGCKIPYEEGPGPGPLAEVRDLPGSAPAKEDGFSWLLPPPPPPPLPFQTSQDAPPNLTASLFTHSEVQVLGDPFPVVNPSYTSSFVLTCPEVSAFAGAQRTSGSDQPSDPLNSPSLLAL

SEQ ID NO: 210 - DNA, 3667 bp, Homo sapiens
attcataagactcagagctacggccacggcagggacacgcggaaccaagacttggaaacttgattgttgtggttcttcttgggggttatgaaatttcattaatctttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgccgcctcccaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggaggtgagagatttgccgggctcagcaccggctaaggaagatggcttcagctggctgctgccgcccccgccaccaccgcccctgcccttccagaccagccaagacgcaccccccaacctgacggcttctctctttacacacagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctctgtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggattaagggacgggggtgggaggtaggctgtggggtgggctggagtcctctccagagaggctcaacaaggaaaaatgccactccctacccaatgtctcccacacccaccctttttttggggtgcctaggttggtttcccctgcactcccgaccttagcttattgatcccacatttccatggtgtgagatcctctttactctgggcagaagtgagccccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccagcctaggacgccaacttctcccaccccttggcccctcacatcctctccaggaagggagtgaggggctgtgacatttttccggagaagatttcagagctgaggctttggtacccccaaacccccaatatttttggactggcagactcaaggggctggaatctcatgattccatgcccgagtccgcccatccctgaccatggttttggctctcccaccccgccgttccctgcgcttcatctcatgaggatttctttatgaggcaaatttatattttttaatatcggggggtggaccacgccgccctccatccgtgctgcatgaaaaacattccacgtgccccttgtcgcgcgtctcccatcctgatcccagacccattccttagctatttatccctttcctggtttccgaaaggcaattatatctattatgtataagtaaatatattatatatggatgtgtgtgtgtgcgtgcgcgtgagtgtgtgagcgcttctgcagcctcggcctaggtcacgttggccctcaaagcgagccgttgaattggaaactgcttctagaaactctggctcagcctgtctcgggctgacccttttctgatcgtctcggcccctctgattgttcccgatggtctctctccctctgtcttttctcctccgcctgtgtccatctgaccgttttcacttgtctcctttctgactgtccctgccaatgctccagctgtcgtctgactctgggttcgttggggacatgagattttattttttgtgagtgagactgagggatcgtagatttttacaatctgtatctttgacaattctgggtgcgagtgtgagagtgtgagcagggcttgctcctgccaaccacaattcaatgaatccccgacccccctaccccatgctgtacttgtggttctctttttgtattttgcatctgaccccggggggctgggacagattggcaatgggccgtcccctctccccttggttctgcactgttgccaataaaaagctcttaaaaacgca

SEQ ID NO: 211 - protein, 235 aa, Homo sapiens
MFRDFGEPGPSSGNGGGYGGPAQPPAAAQAAQQKFHLVPSINTMSGSQELQWMVQPHFLGPSSYPRPLTYPQYSPPQPRPGVIRALGPPPGVRRRPCEQETDKLEDEKSGLQREIEELQKQKERLELVLEAHRPICKIPEGAKEGDTGSTSGTSSPPAPCRPVPCISLSPGPVLEPEALHTPTLMTTPSLTPFTPSLVFTYPSTPEPCASAHRKSSSSSGDPSSDPLGSPTLLAL

SEQ ID NO: 212 - DNA, 1594 bp, Homo sapiens
gagtcagaacccagcagccgtgtaccccgcagagccgccagccccgggcatgttccgagacttcggggaacccggcccgagctccgggaacggcggcgggtacggcggccccgcgcagcccccggccgcagcgcaggcagcccagcagaagttccacctggtgccaagcatcaacaccatgagtggcagtcaggagctgcagtggatggtacagcctcatttcctggggcccagcagttaccccaggcctctgacctaccctcagtacagccccccacaaccccggccaggagtcatccgggccctggggccgcctccaggggtacgtcgaaggccttgtgaacaggagactgacaaactggaagatgagaaatctgggctgcagcgagagattgaggagctgcagaagcagaaggagcgcctagagctggtgctggaagcccaccgacccatctgcaaaatcccggaaggagccaaggagggggacacaggcagtaccagtggcaccagcagcccaccagccccctgccgccctgtaccttgtatctccctttccccagggcctgtgcttgaacctgaggcactgcacacccccacactcatgaccacaccctccctaactcctttcacccccagcctggtcttcacctaccccagcactcctgagccttgtgcctcagctcatcgcaagagtagcagcagcagcggagacccatcctctgacccccttggctctccaaccctcctcgctttgtgaggcgcctgagccctactccctgcagatgccaccctagccaatgtctcctccccttcccccaccggtccagctggcctggacagtatcccacatccaactccagcaacttcttctccatccctctaatgagactgaccatattgtgcttcacagtagagccagcttggggccaccaaagctgcccactgtttctcttgagctggcctctctagcacaatttgcactaaatcagagacaaaatatttcccatttgtgccagaggaatcctggcagcccagagactttgtagatccttagaggtcctctggagccctaaccccttccagatcactgccacactctccatcaccctcttcctgtgatccacccaaccctatctcctgacagaaggtgccactttacccacctagaacactaactcaccagccccactgccagcagcagcaggtgattggaccaggccattctgccgccccctcctgaaccgcacagctcaggaggcgcccttggcttctgtgatgagctgatctgcggatctcagctttgagaagccttcagctccagggaatccaagcctccacagcgagggcagctgctatttattttcctaaagagagtatttttatacaaacctaccaaaatggaataaaaggcttgaagctgtggcctgagtgcctcactggacccagaggccaatgggagagtatttggagccctaggtcccagccttagctctacagactcactgcatgaccttggacaaattctttgatatttttggactttgtcttatctgacaagtggggctacatccgctcggcctcatctccgggactg

SEQ ID NO: 213 - protein, 326 aa, Homo sapiens
MYQDYPGNFDTSSRGSSGSPAHAESYSSGGGGQQKFRVDMPGSGSAFIPTINAITTSQDLQWMVQPTVITSMSNPYPRSHPYSPLPGLASVPGHMALPRPGVIKTIGTTVGRRRRDEQLSPEEEEKRRIRRERNKLAAAKCRNRRRELTEKLQAETEELEEEKSGLQKEIAELQKEKEKLEFMLVAHGPVCKISPEERRSPPAPGLQPMRSGGGSVGAVVVKQEPLEEDSPSSSSAGLDKAQRSVIKPISIAGGFYGEEPLHTPIVVTSTPAVTPGTSNLVFTYPSVLEQESPASPSESCSKAHRRSSSSGDQSSDSLNSPTLLAL

SEQ ID NO: 214 - DNA, 6711 bp, Homo sapiens
gtagtgactcatctcgggcagagcgctagggctccgagcgaaccagcgagcgagcgaacgagcggcgctcggcggggacagaaagagggagagagagagagagagagagggagaggcgcggccgggcgaggcgggcccgtccgggagcgggctccggggaaggggtgcgggtctgggcgccggagcggggagcggggccgcgtccctctcagcgccagctctacttgagccccacgagccgctgtccccctggcgcgctcggggccgcgggacgggcgcacgccgccttctcctagtcaagtatccgagccgccccgaaactcgggcggcgagtcggccacgggaagtttattctccggctccttttctaaaaggaagaaacagaagtttctcccagcggacagcttttctttccgcctttttggccctgtctgaaatcgggggtccccagggctggcaggccaggctcgctgggctcctaatcttttttttaatttccaatttttgattgggccgtgggtccccgctgagctccggctgcgcgcgggggcgggagggcgcgcgcaggggagggaccgagagacgcgccgactttttagagggagggatcgggtggacaactggtcccgcggcgctcgcagagccggaaagaagtgctgtaagggacgctcgggggacgctgttcctgaggtgtcgccgcctccctgtcctcgccctccgcggtgggggagaaacccaggagcgaagcccagagcccgcggcgcggccggcggacgaacgagcgcgcagcagccggtgcgcggccgcggcgagggcgggggaagaaaaacaccctgtttcctctccggcccccaccgcggatcatgtaccaggattatcccgggaactttgacacctcgtcccggggcagcagcggctctcctgcgcacgccgagtcctactccagcggcggcggcggccagcagaaattccgggtagatatgcctggctcaggcagtgcattcatccccaccatcaacgccatcacgaccagccaggacctgcagtggatggtgcagcccacagtgatcacctccatgtccaacccataccctcgctcgcacccctacagccccctgccgggcctggcctctgtccctggacacatggccctcccaagacctggcgtgatcaagaccattggcaccaccgtgggccgcaggaggagagatgagcagctgtctcctgaagaggaggagaagcgtcgcatccggcgggagaggaacaagctggctgcagccaagtgccggaaccgacgccgggagctgacagagaagctgcaggcggagacagaggagctggaggaggagaagtcaggcctgcagaaggagattgctgagctgcagaaggagaaggagaagctggagttcatgttggtggctcacggcccagtgtgcaagattagccccgaggagcgccgatcgcccccagcccctgggctgcagcccatgcgcagtgggggtggctcggtgggcgctgtagtggtgaaacaggagcccctggaagaggacagcccctcgtcctcgtcggcggggctggacaaggcccagcgctctgtcatcaagcccatcagcattgctgggggcttctacggtgaggagcccctgcacacccccatcgtggtgacctccacacctgctgtcactccgggcacctcgaacctcgtcttcacctatcctagcgtcctggagcaggagtcacccgcatctccctccgaatcctgctccaaggctcaccgcagaagcagtagcagcggggaccaatcatcagactccttgaactcccccactctgctggctctgtaacccagtgcacctccctccccagctccggagggggtcctcctcgctcctccttcccagggaccagcaccttcaagcgctccagggccgtgagggcaagagggggacctgccaccagggagcttcctggctctgggggacccaggtgggacttagcagtgagtattggaagacttgggttgatctcttagaagccatgggacctcctccctcattcatcttgcaagcaaatcccatttcttgaaaagccttggagaactcggtttggtagacttggacatctctctggcttctgaagagcctgaagctggcctggaccattcctgtccctttgttaccatactgtctctggagtgatggtgtccttccctgccccaccacgcatgctcagtgccttttggtttcaccttccctcgacttgaccctttcctcccccagcgtcagtttcactccctcttggtttttatcaaatttgccatgacatttcatctgggtggtctgaatattaaagctcttcatttctggagatggggcagcaggtggctcttctgctggggctgacttgtccagaaggggacaaagtgcaatacagagccttccctaccctgacgcctcccagtcatcatctccagaactcccagcggggctccctgagctctcaaggagatgctgccatcactgggaggctcagaggacccttcctgcccaccttcggagacggcttctggaggaacggcttggccagaagacagggtgtgagtgagacagtggggcacaggttgggtttgccaaacgcctaattaccaggccaggaagcatgccaacaaagccacacgggtgtcctagccagcttcccttcacctggtgtcttgagtagggcgtctcctgtaattactgccttgccattctgcccctggacccttctctccggaccagggaggcgtccctccctaggagccacacattatactccaagtccctgccgggctccgcctttcccccaccctggctctcagggtgacgccacccacagagatttaatgagcgtgggcctggaccttccccagatgctgccaggcagcccctccccaagcctcaaagaagcatttgctgaggatggagaggcaggggagggaggcgggaggccgtcactggagtggcgtctgcagcagctgctgccccagcacccgctcagcctgtcctggctgctcacctccccgcagggcaccgggcctttcctgccctctgtggtcatctgccacctgctggatcaagtgctttctcttttacactcccctgtccccaccccagtgcactcttctggcccaggcagcaagcaagctgtgaacagctggcctgagctgtcgctgtggcttgtggctcatgcgccattcctggttgtctgttgaatctttctggctgctggaattggagataggatgttttgcttcccactgcaggagagctgccccctttcacggggttggggaagggtccccctggcctccagcaggagcacagctcagcagggtccctgctgcccacccctctgagccttttctccccagggtatggctcctgctgagtttcttgtccagcagggccttgacaggaatccagggagtagctcctggccagaaccagcctctgcggggcttgtgctctgcaaagactctgctgctggggattcagctctagaggtcacagtatcctcgtttgaaagataattagatcccccgtggagaaagcagtgacacattcacacagctgttccctcgcatgttatttcatgaacatgcctgttttcgtgcactagacacacagagtggaacagccgtatgcttaaagtacatgggccagtgggactggaagtgacctgtacaagtgatgcagaaaggagggtttcaaagaaaaaggattttgtttaaaatactttaaaaatgttatttcctgcatcccttggctgtgatgcccctctcccgatttcccaggggctctgggagggacccttctaagaagattgggcagttgggtttctggcttgagatgaatccaagcagcagaatgagccaggagtagcaggagatgggcaaagaaaactggggtgcactcagctctcacaggggtaatcatctcaagtggtatttgtagccaagtgggagctattttcttttttgtgcatatagatatttcttaaatgaagctgctttcttgtcttttatttctaaaagcccccttataccccactttgtgcagcaaagatccccgtgcaggtcacagcctgatttgtggccaggctggacaaattcctgaggcacaacttggcttcagttcagatttcaagctgtgttggtgttgggaccagcagaaggcaaacgtccagccaacacacaggactgtaagaggactctgagctacgtgccctgtgaagacccccaggctttgtcataggaggtcgttcagcttccccaaagtcagaggtgatttgatttggggaagactgaatattcacacctaagtcgtgagcatatcctgagttttacttccttatggcttgccctccaagttctctctctcatacacacacacacccttgctccagaatcaccagacacctccatggctccagctatgggaacagctgcattggggctgcctttctgtttggcttaggaacttctgtgcttcttgtggctccactcgcgaggcagctcggaggtgtggactccgattgggctgcaggcagctctgggacggcacagggcgggcgctctgatcagctcgtgtaaaacacaccgtcttcttggcctcctggccagtctttctgcgaatagtcctctccctggccagttgaatgggggaagctgctggcacaggaaggagaggcgatcccggctgaggcttaggaaattgctggagccggctccaagcagataattcactggggaggttttcagagtcaaacatcattctgcctgtgttgggggccaggtgtgtcacacaagcatctcaaagtcaaaagccatctggggctgctgcttctgtttctcaggctctggggaaaggaatctccctctcctctcacttgattccaagtgtggttgaattgtctggagcactgggactttttttctcttttccttgatggaccaacagtgcaaatgcaatctcgccatttaactttcaggtcgatttcctttcctgatcagacatctttgtgccccctttaggaaggaaaagaatacacctacgatgtgccaggcactgtgttaggcgcttttatatagatcctcgttaggatgagactaagggatgaggacatctctttataaaaggcccctaagtaatggataaacagaaacacttagaggtgagaaggtctgtcttcaagatccaaggtaagattgccttcagtctgatgtttgttctcaaggacttatcccctacaatattctcccactccatacttctccttctaccccaccatgtgctcccgtgcactcctcagatggtcagaggggtaacccaagtccttagagaatttggggaccaatagaatatgtgatgtgtgaattttctttaaaaaacttaaggagtctttgctaccttctgcttgttgagttgttttggcattcatattaaaagccagcatctcactatttattgacaggttgggctgtgtgtgtgcgcatgtgtgtatacatttccaggcgtgcctgtgtcctgtagctttttaaaaggaaacccagtcatcccactatgaatctggcatcttcttatgcttctagtgttttggccatacatcaaccaaggggtttaatttatccaatgcttgacgacatgttcaggaggggctggatcaaattttgagagggttatgggaaagggagggggagaagaaattgacatttattttattatttattttaaatgtttacatcttctttatgttgtatcaagcctgaatagaaactgatagcattaaaatactccgttcctctctctcttctcgcttcctttttttttttttttttaaatttaggataacacatttttgtttctaaagtgatttgtgatttgtgctgtataaactgtataaaaggttctgtttttaaaggtggattttcattcctctggggacagtggtcgccaagacatctacattgtaagagaacacagtggaagatcctgtcctgattctcaaaaattattttctctgtatgattaaaagtttattccatttattttagtttgtgtttacttgattttgaggaagaaaatatttgactttgtgtaaagagtagggtatcagggtgtcttttctgccgtgggagatgtgtatatatatagtattttggtgtatagtagaaaataagctttgtgcatctgtatttgagatatgttaatgacgtggagtaaagtcagctgtaagactctggaggcaaacaagttgtatatggttcatatggctctatggggaatttaattacctttctgggcactttttttttttttttttttttaagtaatggtgaaatggtcccattggagagtctcctaaatagaccttccaggcagaaccgcaagctcaaaatctttgtatagttttgaaaattgaggagtagctttgtttggaagcctttctggtggtggtttttgttgttgttgttgttttgttgttttactatatgtaatacaagcctacagtatttgcactaaagaaagcttgttagaaaaagcttgctgctatggaagaaagaacatattaaaacttctttcccttgcgatttttttgggggaggggggttagcatttccactttcagttgagtagcattttgtagaataaaatgaattaagattgaagagcc

SEQ ID NO: 215 - protein, 331 aa, Homo sapiens
MTAKMETTFYDDALNASFLPSESGPYGYSNPKILKQSMTLNLADPVGSLKPHLRAKNSDLLTSPDVGLLKLASPELERLIIQSSNGHITTTPTPTQFLCPKNVTDEQEGFAEGFVRALAELHSQNTLPSVTSAAQPVNGAGMVAPAVASVAGGSGSGGFSASLHSEPPVYANLSNFNPGALSSGGGAPSYGAAGLAFPAQPQQQQQPPHHLPQQMPVQHPRLQALKEEPQTVPEMPGETPPLSPIDMESQERIKAERKRMRNRIAASKCRKRKLERIARLEEKVKTLKAQNSELASTANMLREQVAQLKQKVMNHVNSGCQLMLTQQLQTF

SEQ ID NO: 216 - DNA, 3257 bp, Homo sapiens
gctcagagttgcactgagtgtggctgaagcagcgaggcgggagtggaggtgcgcggagtcaggcagacagacagacacagccagccagccaggtcggcagtatagtccgaactgcaaatcttattttcttttcaccttctctctaactgcccagagctagcgcctgtggctcccgggctggtgtttcgggagtgtccagagagcctggtctccagccgcccccgggaggagagccctgctgcccaggcgctgttgacagcggcggaaagcagcggtacccacgcgcccgccgggggaagtcggcgagcggctgcagcagcaaagaactttcccggctgggaggaccggagacaagtggcagagtcccggagccaacttttgcaagcctttcctgcgtcttaggcttctccacggcggtaaagaccagaaggcggcggagagccacgcaagagaagaaggacgtgcgctcagcttcgctcgcaccggttgttgaacttgggcgagcgcgagccgcggctgccgggcgccccctccccctagcagcggaggaggggacaagtcgtcggagtccgggcggccaagacccgccgccggccggccactgcagggtccgcactgatccgctccgcggggagagccgctgctctgggaagtgagttcgcctgcggactccgaggaaccgctgcgcacgaagagcgctcagtgagtgaccgcgacttttcaaagccgggtagcgcgcgcgagtcgacaagtaagagtgcgggaggcatcttaattaaccctgcgctccctggagcgagctggtgaggagggcgcagcggggacgacagccagcgggtgcgtgcgctcttagagaaactttccctgtcaaaggctccggggggcgcgggtgtcccccgcttgccacagccctgttgcggccccgaaacttgtgcgcgcagcccaaactaacctcacgtgaagtgacggactgttctatgactgcaaagatggaaacgaccttctatgacgatgccctcaacgcctcgttcctcccgtccgagagcggaccttatggctacagtaaccccaagatcctgaaacagagcatgaccctgaacctggccgacccagtggggagcctgaagccgcacctccgcgccaagaactcggacctcctcacctcgcccgacgtggggctgctcaagctggcgtcgcccgagctggagcgcctgataatccagtccagcaacgggcacatcaccaccacgccgacccccacccagttcctgtgccccaagaacgtgacagatgagcaggagggcttcgccgagggcttcgtgcgcgccctggccgaactgcacagccagaacacgctgcccagcgtcacgtcggcggcgcagccggtcaacggggcaggcatggtggctcccgcggtagcctcggtggcagggggcagcggcagcggcggcttcagcgccagcctgcacagcgagccgccggtctacgcaaacctcagcaacttcaacccaggcgcgctgagcagcggcggcggggcgccctcctacggcgcggccggcctggcctttcccgcgcaaccccagcagcagcagcagccgccgcaccacctgccccagcagatgcccgtgcagcacccgcggctgcaggccctgaaggaggagcctcagacagtgcccgagatgcccggcgagacaccgcccctgtcccccatcgacatggagtcccaggagcggatcaaggcggagaggaagcgcatgaggaaccgcatcgctgcctccaagtgccgaaaaaggaagctggagagaatcgcccggctggaggaaaaagtgaaaaccttgaaagctcagaactcggagctggcgtccacggccaacatgctcagggaacaggtggcacagcttaaacagaaagtcatgaaccacgttaacagtgggtgccaactcatgctaacgcagcagttgcaaacattttgaagagagaccgtcgggggctgaggggcaacgaagaaaaaaaataacacagagagacagacttgagaacttgacaagttgcgacggagagaaaaaagaagtgtccgagaactaaagccaagggtatccaagttggactgggttgcgtcctgacggcgcccccagtgtgcacgagtgggaaggacttggcgcgccctcccttggcgtggagccagggagcggccgcctgcgggctgccccgctttgcggacgggctgtccccgcgcgaacggaacgttggacttttcgttaacattgaccaagaactgcatggacctaacattcgatctcattcagtattaaaggggggagggggagggggttacaaactgcaatagagactgtagattgcttctgtagtactccttaagaacacaaagcggggggagggttggggaggggcggcaggagggaggtttgtgagagcgaggctgagcctacagatgaactctttctggcctgccttcgttaactgtgtatgtacatatatatattttttaatttgatgaaagctgattactgtcaataaacagcttcatgcctttgtaagttatttcttgtttgtttgtttgggtatcctgcccagtgttgtttgtaaataagagatttggagcactctgagtttaccatttgtaataaagtatataatttttttatgttttgtttctgaaaattccagaaaggatatttaagaaaatacaataaactattggaaagtactcccctaacctcttttctgcatcatctgtagatactagctatctaggtggagttgaaagagttaagaatgtcgattaaaatcactctcagtgcttcttactattaagcagtaaaaactgttctctattagactttagaaataaatgtacctgatgtacctgatgctatggtcaggttatactcctcctcccccagctatctatatggaattgcttaccaaaggatagtgcgatgtttcaggaggctggaggaaggggggttgcagtggagagggacagcccactgagaagtcaaacatttcaaagtttggattgtatcaagtggcatgtgctgtgaccatttataatgttagtagaaattttacaataggtgcttattctcaaagcaggaattggtggcagattttacaaaagatgtatccttccaatttggaatcttctctttgacaattcctagataaaaagatggcctttgcttatgaatatttataacagcattcttgtcacaataaatgtattcaaataccaa

SEQ ID NO: 217 - protein, 347 aa, Homo sapiens
MCTKMEQPFYHDDSYTATGYGRAPGGLSLHDYKLLKPSLAVNLADPYRSLKAPGARGPGPEGGGGGSYFSGQGSDTGASLKLASSELERLIVPNSNGVITTTPTPPGQYFYPRGGGSGGGAGGAGGGVTEEQEGFADGFVKALDDLHKMNHVTPPNVSLGATGGPPAGPGGVYAGPEPPPVYTNLSSYSPASASSGGAGAAVGTGSSYPTTTISYLPHAPPFAGGHPAQLGLGRGASTFKEEPQTVPEARSRDATPPVSPINMEDQERIKVERKRLRNRLAATKCRKRKLERIARLEDKVKTLKAENAGLSSTAGLLREQVAQLKQKVMTHVSNGCQLLLGVKGHAF

SEQ ID NO: 218 - DNA, 1830 bp, Homo sapiens
gggaccttgagagcggccaggccagcctcggagccagcagggagctgggagctgggggaaacgacgccaggaaagctatcgcgccagagagggcgacgggggctcgggaagcctgacagggcttttgcgcacagctgccggctggctgctacccgcccgcgccagcccccgagaacgcgcgaccaggcacccagtccggtcaccgcagcggagagctcgccgctcgctgcagcgaggcccggagcggccccgcagggaccctccccagaccgcctgggccgcccggatgtgcactaaaatggaacagcccttctaccacgacgactcatacacagctacgggatacggccgggcccctggtggcctctctctacacgactacaaactcctgaaaccgagcctggcggtcaacctggccgacccctaccggagtctcaaagcgcctggggctcgcggacccggcccagagggcggcggtggcggcagctacttttctggtcagggctcggacaccggcgcgtctctcaagctcgcctcttcggagctggaacgcctgattgtccccaacagcaacggcgtgatcacgacgacgcctacacccccgggacagtacttttacccccgcgggggtggcagcggtggaggtgcagggggcgcagggggcggcgtcaccgaggagcaggagggcttcgccgacggctttgtcaaagccctggacgatctgcacaagatgaaccacgtgacaccccccaacgtgtccctgggcgctaccggggggcccccggctgggcccgggggcgtctacgccggcccggagccacctcccgtttacaccaacctcagcagctactccccagcctctgcgtcctcgggaggcgccggggctgccgtcgggaccgggagctcgtacccgacgaccaccatcagctacctcccacacgcgccgcccttcgccggtggccacccggcgcagctgggcttgggccgcggcgcctccaccttcaaggaggaaccgcagaccgtgccggaggcgcgcagccgggacgccacgccgccggtgtcccccatcaacatggaagaccaagagcgcatcaaagtggagcgcaagcggctgcggaaccggctggcggccaccaagtgccggaagcggaagctggagcgcatcgcgcgcctggaggacaaggtgaagacgctcaaggccgagaacgcggggctgtcgagtaccgccggcctcctccgggagcaggtggcccagctcaaacagaaggtcatgacccacgtcagcaacggctgtcagctgctgcttggggtcaagggacacgccttctgaacgtcccctgcccctttacggacaccccctcgcttggacggctgggcacacgcctcccactggggtccagggagcaggcggtgggcacccaccctgggacctaggggcgccgcaaaccacactggactccggccctcctaccctgcgcccagtccttccacctcgacgtttacaagcccccccttccacttttttttgtatgttttttttctgctggaaacagactcgattcatattgaatataatatatttgtgtatttaacagggaggggaagagggggcgatcgcggcggagctggccccgccgcctggtactcaagcccgcggggacattgggaaggggacccccgccccctgccctcccctctctgcaccgtactgtggaaaagaaacacgcacttagtctctaaagagtttattttaagacgtgtttgtgtttgtgtgtgtttgttctttttattgaatctatttaagtaaaaaaaaaattggttctttattaa

SEQ ID NO: 219 - protein, 304 aa, Homo sapiens
MMKKDALTLSLSEQVAAALKPAAAPPPTPLRADGAPSAAPPDGLLASPDLGLLKLASPELERLIIQSNGLVTTTPTSSQFLYPKVAASEEQEFAEGFVKALEDLHKQNQLGAGAAAAAAAAAAGGPSGTATGSAPPGELAPAAAAPEAPVYANLSSYAGGAGGAGGAATVAFAAEPVPFPPPPPPGALGPPRLAALKDEPQTVPDVPSFGESPPLSPIDMDTQERIKAERKRLRNRIAASKCRKRKLERISRLEEKVKTLKSQNTELASTASLLREQVAQLKQKVLSHVNSGCQLLPQHQVPAY

SEQ ID NO: 220 - DNA, 1929 bp, Homo sapiens
aggagccgccgccagtggagggccgggcgctgcggccgcggccggggcgggcgcagggccgagcggacgggggggcgcgggccccccgggaggccgcggccactcccccccgggccggcgcggcgggggaggcggaggatggaaacacccttctacggcgatgaggcgctgagcggcctgggcggcggcgccagtggcagcggcggcagcttcgcgtccccgggccgcttgttccccggggcgcccccgacggccgcggccggcagcatgatgaagaaggacgcgctgacgctgagcctgagtgagcaggtggcggcagcgctcaagcctgcggccgcgccgcctcctacccccctgcgcgccgacggcgcccccagcgcggcaccccccgacggcctgctcgcctctcccgacctggggctgctgaagctggcctcccccgagctcgagcgcctcatcatccagtccaacgggctggtcaccaccacgccgacgagctcacagttcctctaccccaaggtggcggccagcgaggagcaggagttcgccgagggcttcgtcaaggccctggaggatttacacaagcagaaccagctcggcgcgggcgcggccgctgccgccgccgccgccgccgccggggggccctcgggcacggccacgggctccgcgccccccggcgagctggccccggcggcggccgcgcccgaagcgcctgtctacgcgaacctgagcagctacgcgggcggcgccgggggcgcggggggcgccgcgacggtcgccttcgctgccgaacctgtgcccttcccgccgccgccacccccaggcgcgttggggccgccgcgcctggctgcgctcaaggacgagccacagacggtgcccgacgtgccgagcttcggcgagagcccgccgttgtcgcccatcgacatggacacgcaggagcgcatcaaggcggagcgcaagcggctgcgcaaccgcatcgccgcctccaagtgccgcaagcgcaagctggagcgcatctcgcgcctggaagagaaagtgaagaccctcaagagtcagaacacggagctggcgtccacggcgagcctgctgcgcgagcaggtggcgcagctcaagcagaaagtcctcagccacgtcaacagcggctgccagctgctgccccagcaccaggtgcccgcgtactgagtccgcgcgcggggcgcatgcgcggccaccctccccaaggggcgggctcgcgggggggtgtcgtgggcgccccggacttggagagggtgcggccctggggaccccccctccccgagtgtgcccaggaactcagagagggcgcggcccccggggattccccccccccgagggtgcccaggactcgacaagctggaccccctgctcccgggggggcgagcgcatgacccccccgccctcgcgctgcctctttcccccgcgcggccgccccgtgttgcacaaacccgcgcgtctcggctgcccctttgtacaccgcgccgcggaagggggctccgagggggcgcagcctcaaaccctgcctttcctttacttttacttttttttttttttctttggaagagagaagaacagagtgttcgattctgccctatttatgtttctactcgggaacaaacgttggttgtgtgtgtgtgtgttttcttgtgttggttttttaaagaaatgggaagaagaaaaaaaaattctccgcccctttcctcgatctcgctccccccttcggttctttcgaccggtcccccctcccttttttgttctgttttgttttgttttgctacgagtccacattcctgtttgtaatccttggttcgcccggttttctgttttcagtaaagtctcgttacgccagctcggctctccgcctccttcttcccccgccggggcctggcgggctgggcggggcctggttcgctt

SEQ ID NO: 221 - protein, 326 aa, Homo sapiens
MDLTAIYESLLSLSPDVPVPSDHGGTESSPGWGSSGPWSLSPSDSSPSGVTSRLPGRSTSLVEGRSCGWVPPPPGFAPLAPRLGPELSPSPTSPTATSTTPSRYKTELCRTFSESGRCRYGAKCQFAHGLGELRQANRHPKYKTELCHKFYLQGRCPYGSRCHFIHNPSEDLAAPGHPPVLRQSISFSGLPSGRRTSPPPPGLAGPSLSSSSFSPSSSPPPPGDLPLSPSAFSAAPGTPLARRDPTPVCCPSCRRATPISVWGPLGGLVRTPSVQSLGSDPDEYASSGSSLGGSDSPVFEAGVFAPPQPVAAPRRLPIFNRISVSE

SEQ ID NO: 222 - DNA, 1747 bp, Homo sapiens
agcctgacttcagcgctcccactctcggccgacacccctcatggccaaccgttacaccatggatctgactgccatctacgagagcctcctgtcgctgagccctgacgtgcccgtgccatccgaccatggagggactgagtccagcccaggctggggctcctcgggaccctggagcctgagcccctccgactccagcccgtctggggtcacctcccgcctgcctggccgctccaccagcctagtggagggccgcagctgtggctgggtgcccccaccccctggcttcgcaccgctggctccccgcctgggccctgagctgtcaccctcacccacttcgcccactgcaacctccaccaccccctcgcgctacaagactgagctatgtcggaccttctcagagagtgggcgctgccgctacggggccaagtgccagtttgcccatggcctgggcgagctgcgccaggccaatcgccaccccaaatacaagacggaactctgtcacaagttctacctccagggccgctgcccctacggctctcgctgccacttcatccacaaccctagcgaagacctggcggccccgggccaccctcctgtgcttcgccagagcatcagcttctccggcctgccctctggccgccggacctcaccaccaccaccaggcctggccggcccttccctgtcctccagctccttctcgccctccagctccccaccaccacctggggaccttccactgtcaccctctgccttctctgctgcccctggcacccccctggctcgaagagaccccaccccagtctgttgcccctcctgccgaagggccactcctatcagcgtctgggggcccttgggtggcctggttcggaccccctctgtacagtccctgggatccgaccctgatgaatatgccagcagcggcagcagcctggggggctctgactctcccgtcttcgaggcgggagtttttgcaccaccccagcccgtggcagccccccggcgactccccatcttcaatcgcatctctgtttctgagtgacaaagtgactgcccggtcagatcagctggatctcagcggggagccacgtctcttgcactgtggtctctgcatggaccccagggctgtggggacttgggggacagtaatcaagtaatccccttttccagaatgcattaacccactcccctgacctcacgctggggcaggtccccaagtgtgcaagctcagtattcatgatggtgggggatggagtgtcttccgaggttcttgggggaaaaaaaattgtagcatatttaagggaggcaatgaaccctctcccccacctcttccctgcccaaatctgtctcctagaatcttatgtgctgtgaataataggccttcactgcccctccagtttttatagacctgaggttccagtgtctcctggtaactggaacctctcctgagggggaatcctggtgctcaaattaccctccaaaagcaagtagccaaagccgttgccaaaccccacccataaatcaatgggccctttatttatgacgactttatttattctaatatgattttatagtatttatatatattgggtcgtctgcttcccttgtatttttcttcctttttttgtaatattgaaaacgacgatataattattataagtagactataatatatttagtaatatatattattaccttaaaagtctatttttgtgttttgggcatttttaaataaacaatctgagtgtaa

SEQ ID NO: 223 - protein, 592 aa, Homo sapiens
MFGIQESIQRSGSSMKEEPLGSGMNAVRTWMQGAGVLDANTAAQSGVGLARAHFEKQPPSNLRKSNFFHFVLALYDRQGQPVEIERTAFVGFVEKEKEANSEKTNNGIHYRLQLLYSNGIRTEQDFYVRLIDSMTKQAIVYEGQDKNPEMCRVLLTHEIMCSRCCDKKSCGNRNETPSDPVIIDRFFLKFFLKCNQNCLKNAGNPRDMRRFQVVVSTTVNVDGHVLAVSDNMFVHNNSKHGRRARRLDPSEGTPSYLEHAATPCIKAISPSEGWTTGGATVIIIGDNFFDGLQVIFGTMLVWSELITPHAIRVQTPPRHIPGVVEVTLSYKSKQFCKGTPGRFIYTALNEPTIDYGFQRLQKVIPRHPGDPERLPKEVILKRAADLVEALYGMPHNNQEIILKRAADIAEALYSVPRNHNQLPALANTSVHAGMMGVNSFSGQLAVNVSEASQATNQGFTRNSSSVSPHGYVPSTTPQQTNYNSVTTSMNGYGSAAMSNLGGSPTFLNGSAANSPYAIVPSSPTMASSTSLPSNCSSSSGIFSFSPANMVSAVKQKSAFAPVVRPQTSPPPTCTSTNGNSLQAISGMIVPPM

SEQ ID NO: 224 - DNA, 5408 bp, Homo sapiens
cctgcttcttcaagtgaagggtacctctacaaaaggaaactccagcccctcctgtcctccaccggcctgtgatcattacaaaaaaaaaaaaaaaaaagcaaaaaaaaaaaaaaagcacccaaaccaaaaatcaaccaaccaaacaacccccaacagccaagcatacatctctaattttattattttggtcttttcgttggattttccctttcttctttttttcgggttatcgctcagttttgagcagaggtttacattttttaaaaatttgctttccagcccgccttgatcttctaagtgcgagttcatcgtctgagaaaaaaaaaaatctctggttggcgtttttgtttcttttcttttctttcttttctttcctttttttttttttttaatttttttcaagggggaggagattttccacaagaaaaggttgttttcatgtttgggattcaggaaagcatccaacggagtggaagcagcatgaaggaagagccgctgggcagcggcatgaacgcggtgcggacgtggatgcagggcgccggggtgctggacgccaacacggcggcgcagagcggggtgggtctggcccgggctcactttgagaagcagccgccttccaatctgcggaaatccaacttcttccacttcgtcctggccctctacgacagacagggccagcccgtggagatcgagaggacagcgtttgtggggttcgtggagaaggaaaaagaagccaacagcgaaaagaccaataacggaattcactaccggcttcagcttctctacagcaatgggataaggacggagcaggatttctacgtgcgcctcattgactccatgacaaaacaagccatagtgtatgaaggccaagacaagaacccagaaatgtgccgagtcttgctcacacatgagatcatgtgcagccgctgttgtgacaagaaaagctgtggcaaccgaaatgagactccctcagatccagtgataattgacaggttcttcttgaaatttttcctcaaatgtaaccaaaattgcctaaagaatgcgggaaacccacgtgacatgcggagattccaggtcgtggtgtctacgacagtcaatgtggatggccatgtcctggcagtctctgataacatgtttgtccataataattccaagcatgggcggagggctcggaggcttgacccctcggaaggtacgccctcttatctggaacatgcagctactccctgtatcaaagccatcagcccgagtgaaggatggacgacgggaggtgcgactgtgatcatcataggggacaatttctttgatgggttacaggtcatattcggtaccatgctggtctggagtgagttgatcactcctcatgccatccgtgtgcagacccctcctcggcacatccctggtgttgtggaagtcacactgtcctacaaatctaagcagttctgcaaaggaacaccaggcagattcatttatacagcgctcaacgaacccaccatcgattatggtttccagaggttacagaaggtcattcctcggcaccctggtgaccctgagcgtttgccaaaggaagtaatactcaaaagggctgcggatctggtagaagcactgtatgggatgccacacaacaaccaggaaatcattctgaagagagcggccgacattgccgaggccctgtacagtgttccccgcaaccacaaccaactcccggcccttgctaacacctcggtccacgcagggatgatgggcgtgaattcgttcagtggacaactggccgtgaatgtctccgaggcatcacaagccaccaatcagggtttcacccgcaactcaagcagcgtatcaccacacgggtacgtgccgagcaccactccccagcagaccaactataactccgtcaccacgagcatgaacggatacggctctgccgcaatgtccaatttgggcggctcccccaccttcctcaacggctcagctgccaactccccctatgccatagtgccatccagccccaccatggcctcctccacaagcctcccctccaactgcagcagctcctcgggcatcttctccttctcaccagccaacatggtctcagccgtgaaacagaagagtgctttcgcaccagtcgtcagaccccagacctccccacctcccacctgcaccagcaccaacgggaacagcctgcaagcgatatctggcatgattgttcctcctatgtgaaagaattgccttgaagaattgtattaatgaagaggttggattctgctacagagagtaatctgatacaagtcccagagtggaacttttaactcaggcctttttaagaggaatcacaataactgcagatttttaaacaaacaaaatcaccgaccttgcaaatactgaaattggaagagggatctgcaagtgcagggtgttggttaaagttgtacctcccaagtatttgggggatatatttattctgtattgacaaaagcaaatccactttttctttttcttttttttttttaagcttaattctgcaatcatttgtcttttataaaccgtaaagctctatacaagggacactataaataagactccatgttttaatttatgatgtttttaaagctgtgtaaaggaagaatgaagtggtgatatttacaaaaaagtaaaaaaaaaaaaaaagaaaaaaaggaaaaaaaaaaaagcttgtatgggacagaataggaatgccagttagattttttagaaaaactaagggtcggcttttgcgccttaaagcatatcaaatggtagttagctcagacagtgcattttcaatatctaacttaacatgccaccccttagcagtgcaagcttatttatctcttttgtattgttgtcttaagcaactgtgtaaataaatgcagcctggaaagttaaaacgcgatgtaagtgatcacatttttccctctactcgaaaatccagtgcctctagacagattgttaaaactgcatatttaaatctgatctcattctctccttttacttaagtcagtttcttctgaagccgatggcctctcgagagcttggtggcacacatactgtgtgagaatctcctttgagacttcatggaacagggtccaggcacagaattccacactctgccctccagttaacaagccaaaacctcacgtacgctcccccatttgcaagtttaaagtttactcgtcctaaatgcagacttcatacctatcttccaaaagttgataaaagcaacgtggcaggtattttcgattttcccattccagatactgcctctatcagtcgacccttaccatttgtaacataatagattgaaacaacaggttaagtgctttggaattaagagttaaagggaaccgggggtggagaaaggaaaagaaggttgagacctccaaaacatagttttctgttctatgggaatttttgctctcattatctgggaagtgttcttaaaaataagaattaatagcaaagatgcagcaaagctctgaggatgcatttgcctgatatttttttctttgctcttgtgtttttgtatgtagttataaatactgtagattttttttttgtgattttttgccaaagttgttgttctatttatacattttaatgtcttaagacattttttcaatatcacaaaaagattttactgcgtattttgcaaagaaaaaaagctcactacctttagcttgcacatacttgcaaagttaattaaaaggctttttgttttaaaggggattttgtaaaatatccatataaataatgtatttatctttcgaatttgtacattgcttttcccttcttcctcttccttccacccccaatttattttattgtgtatgtttgctacgtgaaaagtgcgtatttgtttggtcacctacacttgtattagctgtttcaatgtgatttttaaacatttcatttatagttatttttagtattgttataaaccatgcttcagtttttttaatttccacccaaaagtcattgtctatttttgtattatttgtaagttaagaagttttttccaatatatggcaaaaaaaaaaaaatagtagcatattattcttgtagtatttagttcagtagatttaaaaaaaaatgtatcctttgctttggaagcttacaaaacaaccctaatgctgttttactctattaatatgcatggaatctctccctttggagtgacgcattttgtgcattaaattctagggagaaacttcatagaaatcaatgaacatactttctttcttaagtctgcttgtatatttcctctgtctttcacataaatataaaccagcagattggatgccttaacaatgcaaatcatattcatttcacttgtacattgtaactgtgcaccagaactgtcagtcatcactaacattctaagaaaaaagaaaaagaaaaaaagaaaaaaaaaaaaacaaagaaatcgaaaagcacaaaagaactgttttgttaccttaagacaatgtaactttttctagtagagcaagaaatcatttacaacaatgctgcaactgtgcatgcccccatatggattttgcaatggttttcactaggctgtcaagagtgcgatttttatgggttggggtgggtgggggaggggagttgtgggagggtaggggagggaggaaagctgtttttcatggtgagaaataataatgatgactaataataataaaaaaaactggaaaatgtaagcaaggtggacgcattgcttctcggtactcagaaaggttatctgaatttgcgtggtaagcgctggcctgaagatgtacacaagttaaagccatattttatctggtgagccccttaactgtttctgaaggaatgaacggtcagccgggaaggtgtccggcttagaccttgacaacagacactacccatctgtcagccatgtgcagtggttagaactcttcttgaaagtccaaagagcctttaaaatgtgtataatttgtgttttgttgcttctatttctattgattagatgaaaagacattctggccctctgatcctctttcttctccacaaaagttttacaaataaaagatgttcccctaaatacagaatatggctttaagaagaaaatgaaatgaagaattaaattaagatttcagtgttgggggaaaaaatacagcttctggatgactggattgcataacattgccctggcctcacattgtactaggatgcagcttaaatgaagtcatctctaaatctactaacctttcaccttcttatcaaaactttttgaatagacacacactgtacagttcaattgttagagaacctaactactgtagagattgttaaattttttttttttttttgcaaaaattcaagctgtaaaaacttttcaactttcacaatatttaattaaagttacttcctgtctgtga

SEQ ID NO: 225 - protein, 551 aa, Homo sapiens
MFGIQENIPRGGTTMKEEPLGSGMNPVRSWMHTAGVVDANTAAQSGVGLARAHFEKQPPSNLRKSNFFHFVLALYDRQGQPVEIERTAFVDFVEKEKEPNNEKTNNGIHYKLQLLYSNGVRTEQDLYVRLIDSMTKQAIVYEGQDKNPEMCRVLLTHEIMCSRCCDKKSCGNRNETPSDPVIIDRFFLKFFLKCNQNCLKNAGNPRDMRRFQVVVSTTVNVDGHVLAVSDNMFVHNNSKHGRRARRLDPSEATPCIKAISPSEGWTTGGATVIIIGDNFFDGLQVVFGTMLVWSELITPHAIRVQTPPRHIPGVVEVTLSYKSKQFCKGAPGRFVYTALNEPTIDYGFQRLQKVIPRHPGDPERLPKEVLLKRAADLVEALYGMPHNNQEIILKRAADIAEALYSVPRNHNQIPTLGNNPAHTGMMGVNSFSSQLAVNVSETSQANDQVGYSRNTSSVSPRGYVPSSTPQQSNYNTVSTSMNGYGSGAMASLGVPGSPGFLNGSSANSPYGMKQKSAFAPVVRPQASPPPSCTSANGNGLQAMSGLVVPPM

SEQ ID NO: 226 - DNA, 4858 bp, Homo sapiens
attcctcggggagagagggctgagttttgtgcgcctccgtccgctgcgcgcgccgctccaggccccgccgcgccccgcctgcgcccgggactgcgccgcagcactcactgccccgtttatttgtctttggagcaggcgggccgcgccagaagcgggcgatcccgcagtgtcctgcagccgcggacgccgcctggctaggatgacaccacgttgagcgcgcctgcaaacaacaacaacaacaagcgccgccgcggccaccgcgtcctgctccttcgaagcgccgccgccgccggtggagccgcctccgcgcccctggccgtccggagcgcccggccgctggtgtatgtcgcgcctgcccgggacgggctgaagccggcggcggggccggaccgcaggcgccgagcagggcgagggcggccagggcagccgcctgccgccaagccccgagcgccgctgctcgaggaaacgctttcggccgggagctgcggccgccgccagcagttttcatgtttgggattcaggagaatattccgcgcggggggacgaccatgaaggaggagccgctgggcagcggcatgaacccggtgcgctcgtggatgcacacggcgggcgtggtggacgccaacacggccgcccagagcggcgtggggctggcgcgggcgcacttcgagaagcagccgccttccaacctccggaaatccaatttcttccacttcgtgctggcgctctacgataggcaggggcagccggtggagattgaaaggaccgcttttgtggactttgtggagaaagagaaagagccaaacaacgagaaaaccaacaacggcatccactataaactccagttattgtacagcaacggagtcagaacagagcaagatctgtatgttcgcctcatagattcaatgaccaaacaggccatcgtctacgagggccaggacaagaacccggagatgtgccgtgtgctgctgacccacgagatcatgtgcagccggtgctgtgacaagaaaagttgtggcaatagaaacgaaacgccctcagaccctgtaatcattgacagattctttctaaagtttttcctcaagtgcaatcagaactgtttgaagaatgcaggcaaccctcgagatatgcggagattccaggttgttgtatcgacaacagtcaacgtggacggccacgtgctggccgtgtcagacaacatgtttgtgcacaacaattccaaacacgggaggcgggcccgccgcctagacccgtcagaagccactccgtgcatcaaggccatcagtcccagtgaaggctggaccacggggggtgccaccgtcatcataattggcgacaacttctttgacgggctgcaagttgtattcggaactatgttggtgtggagcgagctgataactccccatgccatccgagtccagaccccgccgaggcacattcctggcgtcgtcgaagtgaccctctcctacaaatccaagcagttctgcaaaggtgctcctgggcgctttgtctacaccgcccttaatgaaccaaccatagattacggctttcagaggttgcagaaagtgatcccaagacatccgggtgatcccgaaaggttacccaaggaggtgttactgaagcgggcggcggacctggtggaagccttatacggaatgcctcacaacaaccaggagatcatcttgaagcgagcggcggacatcgccgaggcgctgtacagcgttccccgcaatcacaaccagatccccaccctgggcaacaaccctgcacacacgggcatgatgggcgtcaactccttcagcagccagctagccgtcaacgtgtcagagacgtcacaagccaacgaccaagtcggctacagtcgcaatacaagcagcgtgtccccgcgaggctacgtccccagcagtactccccagcagtccaattacaacacagtcagcactagcatgaatggatatggaagtggcgccatggccagtctaggggtccctggctcgcctggatttcttaatggctcctccgctaactctccctacggcatgaaacagaagagcgccttcgcgcccgtggtccggccccaagcctctcctcctccttcctgcaccagcgccaacgggaatggactgcaagctatgtctgggctggtagtcccgccaatgtgagggacttctgtttaccttccgcagcacccagcatcaaaggacggacttcaggggacacgtttagtatattaagacatgctgatggaaacagtatcttcaaaaaaatcagcagcaattgaaatgctacaaaagactttgtttaaagattttatttaaactattaagaatcaacatgcaaacagcctacttcttcatgaacaattccattttattgactgaacttttctcatattttcacatttctcagtcctgaagaataaggaaaacaaagcgacgcctattttgtataaagtttccgactccgtcttggccatgtctagtaattgctatgtgttgggagaaactttgtgaatgcaccattttgatgatcatgaaacgctgatgaaaaatgcctccaaacatttttctgtactcatacttagattcacaatggttgtgtatctctataatgtgaaatatttttttgtggtgataaaaagagggccaaggaggtatgagccatcagactggaaaaaaggatgactatatgatgaggagaaactggggtggcagggagggagggagggtttatcactgcttaacttcatcttcatgaaatgaaactttgtaacttattgtagttagaaattgtaactttgatattgaattctcttgccttcaacaagcacactgacagagaaaaaatgctactgtctgttggttccaatattctcccactgctagagcttcctgttaagcaagtgtgatctgcaacattttttcaacttttgctagcactgtatactattgcattcttaggctactgtgaggtctatgtttcttgtaccagaaattgtccttttgacttctagatccttcttccctaatgtgttttgtatgtggttataaaattgtagacttttgtgattttgccaaagttgtagctaaatatttatacacttgtcttgaatttttttcagatccacttaaaatatttagaaaaacaagttttattccttatgtgtcttataaggaataaaatggtcttcatttgacacttactttcccatgaacacttgcagttgctaagggactttattttgtaacatatcaattataaatattgtatttatctttgaaattttgtacattgcttttcccaccttttcctttttcttctttcttgtctgtattggtttttgatcacggcctggtgttgtgatactgggaagagcattagccaagaacttgtctctttgatctgtttcgttaagctgaaccagtgtctttacatttcatttgtacttcaaaaaatatgctattgtttagactttccatcctttttttttttattttgaggaaaagtcaaattcattgtttatttttatattatttttaagttatctgaacaaatacttttgaaaaaaaagtttgttgtatagtcaaaacaaatcggtgccacccggccgtgacaaatcctagtagattctgtgcatgtggagcggccgcgaagaggtgacaccgtttggggctgtgtccttattttattttatttttttgtagaatgtaaaaagtcattttagatgccacccattgactttgccacatagctgaactgtgtttactggaaaaattcagaggcctaaagtttaaaataaaatttacttctgatgttttaattaaaatgtttgccacattaacttttctgatgccttaaaagtgaacttctttaaagaacctttgtgctattttatcacaggcttacactacaattgttaataaatacttcatttggagatgtatggtgtaaaacacacaaacacacacaaaaaagcacaagcccgctgcatgacccgtctctcctttctgggactatttctgctgcgtcctgcaccctcctgggcccacctccgattcacagaggtttcagggggacccaaatcactgctggttttcaatttttttttaacaatacatttttgtggtcagttccaacagcactgtccgtacttttaaaactggaatgacctccttcagatatcgtgcctcttagtgccaaacccacagtgagaccaaaagtgtcaggtgtttttttttttttctttctcctttgcactaagtgctttgcagacacggcacagcaaacattttgcaaactgcagcagaaatcgaatttaaaacaaaaaggagggactttaaaataccttcttgacaaaaatcaacaatgcacaacttacaaagtgttcattctagggacaaaattaaataaacagaatgtccccaggagtcagcaggtcacagtctggctttgtgatggttgacaaggtctagctacatgggaaagcctgagaagtcactttggaactaaattgcctccattttattttgtacgagtaagggtttgatctacaaaagagctcacatggacgcactgagaacgcctgccagcttccccatgccctcacttggtttgtgttttaggttaagtagtcaatgcccacatcacttcactgtctcaagactgagcacttcactaaatggtagattttactgttaaagaccctacaataagattgttttatctgtacattttttcagatatttaactgtataaaaatgttcattttacacaatatttaattaaagtatttcttgtctgtgaatttcacttttggtaattttctctgtttttgattattaaaatgactaaacactaa

SEQ ID NO: 227 - protein, 373 aa, Homo sapiens
MASELAMSNSDLPTSPLAMEYVNDFDLMKFEVKKEPVETDRIISQCGRLIAGGSLSSTPMSTPCSSVPPSPSFSAPSPGSGSEQKAHLEDYYWMTGYPQQLNPEALGFSPEDAVEALISNSHQLQGGFDGYARGAQQLAAAAGAGAGASLGGSGEEMGPAAAVVSAVIAAAAAQSGAGPHYHHHHHHAAGHHHHPTAGAPGAAGSAAASAGGAGGAGGGGPASAGGGGGGGGGGGGGGAAGAGGALHPHHAAGGLHFDDRFSDEQLVTMSVRELNRQLRGVSKEEVIRLKQKRRTLKNRGYAQSCRFKRVQQRHVLESEKNQLLQQVDHLKQEISRLVRERDAYKEKYEKLVSSGFRENGSSSDNPSSPEFFM

SEQ ID NO: 228 - DNA, 6900 bp, Homo sapiens
cttgctggatcagaggctttaaaatcttttttcatcttctagctgtagctcgggctgcttgtcggcttggcctccccctcccccctttgctctctgcctcgtctttccccaggacttcgctattttgcttttttaaaaaaaggcaagaaagaactaaactcccccctccctctcctccagtcgggctgcacctctgccttgcactttgcacagaggtagagagcgcgcgagggagagagaggaaagaaaaaaaataataaagagagccaagcagaagaggaggcgagaagcatgaagtgttaactcccccgtgccaaggcccgcgccgcccggacagacgcccgccgcgcctccagccccgagcggacgccgcgcgcgccctgcctgcagcccgggccggcgaggcgagcccttccttatgcaaagcgcgcagcggagcggcgagcgggggacgccgcgcaccgggccgggctcctccagcttcgccgccgcagccaccaccgccgccaccgcagctcgcggaggatcttcccgagcctgaagccgccggctcggcgcgcaaggaggcgagcgagcaaggaggggccggggcgagcgagggagcacattggcgtgagcaggggggagggagggcgggcgcggggggcgcgggcagggcgggggggtgtgtgtgtgagcgcgctcggaggtttcgggccagccaccgccgcgcaagctagaagcgccccagcccggcaagctggctcacccgctggccacccagcacagcccgctggcccctctcctgcagcccatctggcggagcggcggcggcggcggcggcggcggcaggagaatggcatcagaactggcaatgagcaactccgacctgcccaccagtcccctggccatggaatatgttaatgacttcgatctgatgaagtttgaagtgaaaaaggaaccggtggagaccgaccgcatcatcagccagtgcggccgtctcatcgccgggggctcgctgtcctccacccccatgagcacgccgtgcagctcggtgcccccttcccccagcttctcggcgcccagcccgggctcgggcagcgagcagaaggcgcacctggaagactactactggatgaccggctacccgcagcagctgaaccccgaggcgctgggcttcagccccgaggacgcggtcgaggcgctcatcagcaacagccaccagctccagggcggcttcgatggctacgcgcgcggggcgcagcagctggccgcggcggccggggccggtgccggcgcctccttgggcggcagcggcgaggagatgggccccgccgccgccgtggtgtccgccgtgatcgccgcggccgccgcgcagagcggcgcgggcccgcactaccaccaccaccaccaccacgccgccggccaccaccaccacccgacggccggcgcgcccggcgccgcgggcagcgcggccgcctcggccggtggcgctgggggcgcgggcggcggtggcccggccagcgctgggggcggcggcggcggcggcggcggcggaggcggcgggggcgcggcgggggcggggggcgccctgcacccgcaccacgccgccggcggcctgcacttcgacgaccgcttctccgacgagcagctggtgaccatgtctgtgcgcgagctgaaccggcagctgcgcggggtcagcaaggaggaggtgatccggctgaagcagaagaggcggaccctgaaaaaccgcggctatgcccagtcctgccgcttcaagagggtgcagcagagacacgtcctggagtcggagaagaaccagctgctgcagcaagtcgaccacctcaagcaggagatctccaggctggtgcgcgagagggacgcgtacaaggagaaatacgagaagttggtgagcagcggcttccgagaaaacggctcgagcagcgacaacccgtcctctcccgagtttttcatgtgagtctgacacgcgattccagctagccaccctgataagtgctccgcgggggtccggctcgggtgtgggcttgctagttctagagccatgctcgccaccacctcaccacccccacccccaccgagtttggcccccttggccccctacacacacacaaacccgcacgcacacaccacacacacacacacacacacacacacaccccacaccctgctcgagtttgtggtggtggtggctgttttaaactggggagggaatgggtgtctggctcatggattgccaatctgaaattctccataacttgctagcttgttttttttttttttttacacccccccgccccacccccggacttgcacaatgttcaatgatctcagcagagttcttcatgtgaaacgttgatcacctttgaagcctgcatcattcacatattttttcttcttcttccccttcagttcatgaactggtgttcattttctgtgtgtgtgtgtgttttattttgtttggatttttttttttaattttacttttagagcttgctgtgttgcccaccttttttccaacctccaccctcactccttctcaacccatctcttccgagatgaaagaaaaaaaaaagcaaagtttttttttcttctcctgagttcttcatgtgagattgagcttgcaaaggaaaaaaaaatgtgaaatgttatagacttgcagcgtgccgagttccatcgggttttttttttagcattgttatgctaaaatagagaaaaaaatcctcatgaaccttccacaatcaagcctgcatcaaccttctgggtgtgacttgtgagttttggccttgtgatgccaaatctgagagtttagtctgccattaaaaaaactcattctcatctcatgcattattatgcttgctactttgtcttagcaacaatgaactataactgtttcaaagactttatggaaaagagacattatattaataaaaaaaaaaagcctgcatgctggacatgtatggtataattattttttcctttttttttccttttggcttggaaatggacgttcgaagacttatagcatggcattcatacttttgttttattgcctcatgacttttttgagtttagaacaaaacagtgcaaccgtagagccttcttcccatgaaattttgcatctgctccaaaactgctttgagttactcagaacttcaacctcccaatgcactgaaggcattccttgtcaaagataccagaatgggttacacatttaacctggcaaacattgaagaactcttaatgttttctttttaataagaatgacgccccactttggggactaaaattgtgctattgccgagaagcagtctaaaatttattttttaaaaagagaaactgccccattatttttggtttgttttatttttattttatattttttggcttttggtcattgtcaaatgtggaatgctctgggtttctagtatataatttaattctagtttttataatctgttagcccagttaaaatgtatgctacagataaaggaatgttatagataaatttgaaagagttaggtctgtttagctgtagattttttaaacgattgatgcactaaattgtttactattgtgatgttaaggggggtagagtttgcaaggggactgtttaaaaaaagtagcttatacagcatgtgcttgcaacttaaatataagttgggtatgtgtagtctttgctataccactgactgtattgaaaaccaaagtattaagaggggaaacgcccctgtttatatctgtaggggtattttacattcaaaaatgtatgtttttttttcttttcaaaattaaagtatttgggactgaattgcactaagatataacctgcaagcatataatacaaaaaaaaattgcaaaactgtttagaacgctaataaaatttatgcagttataaaaatggcattactgcacagttttaagatgatgcagatttttttacagttgtattgtggtgcagaactggattttctgtaacttaaaaaaaaatccacagttttaaaggcaataatcagtaaatgttattttcagggactgacatcctgtctttaaaaagaaatgaaaagtaaatcttaccacaataaatataaaaaaatcttgtcagttacttttcttttacatattttgctgtgcaaaattgttttatatcttgagttactaactaaccacgcgtgttgttcctatgtgcttttctttcattttcaattctggttatatcaagaaaagaataatctacaataataaacggcatttttttttgattctgtactcagtttcttagtgtacagtttaactgggcccaacaacctcgttaaaagtgtaaaatgcatccttttctccagtggaaggattcctggaggaatagggagacagtaattcagggtgaaattataggctgttttttgaagtgaggaggctggccccatatactgattagcaatatttaatatagatgtaaattatgacctcatttttttctccccaaagttttcagttttcaaatgagttgagccataattgcccttggtaggaaaaacaaaacaaaacagtggaactaggcttcctgagcatggccctacacttctgatcaggagcaaagccatccatagacagaggagccggacaaatatggcgcatcagaggtggcttgcgcacatatgcattgaacggtaaagagaaacagcgcttgccttttcactaaagttgactatttttccttcttctcttacacaccgagattttcttgttagcaaggcctgacaagatttaacataaacatgacaaatcatagttgtttgttttgttttgcttttctctttaacactgaagatcatttgtcttaaataggaaaaagaaaatccactccttacttccatatttccaagtacatatctggtttaaactatgttatcaaatcatatttcaccgtgaatattcagtggagaacttctctacctggatgagctagtaatgatttcagatcatgctatccccagaaataaaagcaaaaaataatacctgtgtggaatataggctgtgctttgatttactggtatttaccccaaaataggctgtgtatgggggctgacttaaagatcccttggaaagactcaaaactaccttcactagtaggactcctaagcgctgacctatttttaaatgacacaaattcatgaaactaatgttacaaattcatgcagtttgcactcttagtcatcttcccctagcacaccaatagaatgttagacaaagccagcactgttttgaaaatacagccaaacacgatgacttttgttttgttttctgccgttcttaaaagaaaaaaagataatattgcaactctgactgaaagacttatttttaagaaaacaggttgtgtttggtgctgctaagttctggccagtttatcatctggccttcctgcctattttttacaaaacacgaagacagtgtgtaacctcgacattttgaccttcctttatgtgctagtttagacaggctcctgaatccacacttaattttgcttaacaaaagtcttaatagtaaacctcccctcatgagcttgaagtcaagtgttcttgacttcagatatttctttcctttttttttttttttcctcatcacaactaagagatacacaaactctgaagaagcagaaatggagagaatgcttttaacaaaaaagcatctgatgaaagattttaggcaaacattctcaaaataagagtgatattctggatgtagttattgcagttatctcatgacaaatgaggcctggattggaaggaaaatatagttgtgtagaattaagcattttgataggaatctacaaggtagttgaatataataagcaggtttgggcccccaaactttagaaaatcaaatgcaaaggtgctggcaaaaatgaggtttgagtggctggctgtaagagaaggttaactcctagtaaaaggcatttttagaaataacaattactgaaaactttgaagtatagtgggagtagcaaacaaatacatgttttttttttcttacaaagaactcctaaatcctgagtaagtgccattcattacaataagtctctaaatttaaaaaaaaaaaaatcatatgaggaaatctagctttcccctttacgctgcgtttgatctttgtctaaatagtgttaaaattcctttcattccaattacagaactgagcccactcgcaagttggagccatcagtgggatacgccacattttggaagccccagcatcgtgtacttaccagtgtgttcacaaaatgaaatttgtgtgagagctgtacattaaaaaaaatcatcattattattattatttgcagtcatggagaaccacctacccctgacttctgtttagtctcctttttaaataaaaattactgtgttagagaagaaggctattaaatgtagtagttaactatgcctcttgtctgggggtttcatagagaccggtaggaaagcgcactcctgcttttcgatttatggtgtgtgcaagtaaacaggtgcattgctttcaacctgccatactagttttaaaaattcactgaaattacaaagatacatatatatgcatatatataatggaaagtttcccggaatgcaacaattagcattttaaaatcatatataggcatgcacattctaaatagtactttttcatgcttcattgtttctctggcagataattttactaagaagaaaaatagatattcgactccccttccctaaacaaatccacgggcagaggctccagcggagccgagccccctggttttctcgtaggccctagacggtgttgcatttatcagtgatgtcaaacgtgctcatttgtcagacatagctgtaaatgaaaacaatgtgtggcaaaatacaaagttagttaaataca

SEQ ID NO: 229 - protein, 100 aa, Homo sapiens
MATFPPATSAPQQPPGPEDEDSSLDESDLYSLAHSYLGPLIMPMPTSPLTPALVTGGGGRKGRTKREAAANTNRPSPGGHERKLVTKLQNSERKKRGARR

SEQ ID NO: 230 - DNA, 5345 bp, Homo sapiens
gccaggaaagcagagacagacaaagcgttaggagaagaagagaggcagggaagacaagccaggcacgatggccaccttcccaccagcaaccagcgccccccagcagcccccaggcccggaggacgaggactccagcctggatgaatctgacctctatagcctggcccattcctacctcgggcctctcatcatgcctatgcccacttcacctctgactcctgccttggttacaggaggtggaggccggaaaggtcgcaccaagagagaagctgctgccaacaccaaccgccccagccctggcgggcacgagaggaaactggtgaccaagctgcagaattcagagaggaagaagcgaggggcacggcgctgagacagagctggagatgaggccagaccatggacactacacccagcaatagagacgggactgcggaggaaggaggacccaggacaggatccaggccggcttgccacaccccccacccctaggacttattcccgctgactgagtctctgaggggctaccaggaaagcgcctccaaccctagcaaaagtgcaagatggggagtgagaggctgggaatggaggggcagagccaggaagatcccccagaaaagaaagctacagaagaaactggggctcctccagggtggcagcaacaataaatagacacgcacggcagccacagcttgggtgtgtgttcatccttgttctttgtgtgtttttgttcgggcatgtgtgtgcttgcctgtgcctgcacattcatgagcctgagagagcatctttgatgtgtatttgtgtttggtgtatgtatctggggcagggagtgttcctgctcttgcagggtctacgctgtgaatgcagcttttggtttgtttgcttttgcttgcatatattttagtgcatacatttctgtgggctcctacgtagtggaaaggaatttcttctgcttttttgcgatactgcccatgaaacacggccctccccagcacctgtttttgttgattgtgtcctgttcatagacgggaacgctacttatgagtgccatctaaaagtcagagaaaactgagatttaaaatattaaaagccagggccgggggcagtggctcacgcctgtaatcccagcactttgggaggccgaggtgggtggatcacaaagtcaggagttcaagaccagcctgaccaacatggtgaaaccccatctccactaaaaataccaaaaattagccaagcatggtggcaggtgcctgtaatcccagctgctcaggaggctgaggcagtagaatcgcttgaacccaggaggtagaggttgcagtgagccgacatcgtgccattgcactccagcctgggtgacagagggagactctgtctcaaaacaaacaaacaaacaaaaactaaagtctgggagcagtggctcatgcctgtaatcacagcagtttaggaggccgaagtgggaggattacttgagcctaggagtttgagaccagcctgagcatcatagtaagaccccatctctacaattttttttttgagacagagtctcactctgttgctcaggttagagtgcagtggcaccatcttggctcactgcaacctctgcctcccgggttcaagcaattctcgtgcctacgccccctgagtagctgggattacaggtgagcaccaccacgcctggctaatttttgtttttttgtttttttgatacagagtctcactctgttgctcaggctggagtgcagtggcatgatcgcagctcactgcaacctccgcctcctgggttcaagctattctcctgcttcagcctcctgagtagctgggactacaggcacctgccaccatgcctggctaatttttgtatttttagtagaaacagagtttcaccatgttggccaggatggtctcaatctcttgacctcatgatccacccaccttggcctcccaaagtgctgggattacaggcgtcagccaccacgcctggccaatttttgtatttttagtagagatggggtttcatcatgttggccaggctggtctcaaactcctggcctcaaatgatctgcccacctcagccttccagcctttgggaggccaaggagggaggatcgcttgaggccaggagttcgagaccagcctaggcaacataccaaggccctgtctctacaaaaatttaaaaattagcaaagcatggtggctcatgcctgtagtcctagttgctcagaggctgaagttggaggatcccttgaacccagttggaggctacagtaagccatgatggtgccactgcactgcagcctgagcaatagagtgaaaccatgtattgaaaaagaaagaaagaaagaaagagaaaaagaaggaaggaaggaaaagaaaggaaggaagaaagaaaagaaagagagaaaggagagaaaaagaagaaagagagagaaagagaagaaagaaagaaagaaagaaagaaagaaagaaagaaagaaagaaagaaaggaaggaaggaaagaaagaaagaaagaaggaaagaaagaaagaaagaaagaaagaaagaaagaaagaaaagagcgagccccggcacagtggctcacacctgtaatcccagcactttgggaggccaaggcaggcggatcacctgaggtcagtagttcgagttcgaggcagaagttgtggtgagccaagatcacgccattgcactccagcctgggcaacaagagcaaaactccatctcaaaaaaagaaaaagagagagaaagaaagagagaaggagggaaagaaagaggaaggaaaggagggagggaaggagggaaggaggaaaggagggaaggaaatattaagggatttgccctagctcactcagggctcatattcagggatcttattgtcttcagatatgaggtgggtccccaggccaagggggctgtgggacagggttctgggaagtgagatgggggagggagattcttattcagtgctatgtctcaggaccagagttgaagaaaaatatggggcaaacaggaagtgtggttggagctgagattatttgttgattgagatacaggtttgggttgctattatgaagaatcaaaacaggatacaaagttactcctctcttacttagccccaagtcctcctgggttcaaatggcagctccattgtgttgaggattccagctatttttactcactgttctgccacacccaaaacatggcttccactttgaggcccaaaatagctactccaatacctgccatcacgtttgcatctcagcctgtggaaagagtgtggaagagacagaggaggccacacctcttcaattttagggcataatctaaaagtagaacacatcacatctgctccgaatgtggctacatggccacacccaactacgagagaggttgggaaatgtagcattgagctgcttagccacgtggtagccaaaacttgggcaacagcagggttttatgatgaaagggaaccagagagagtgaatacacgaagaagctagcaagaaacattgcccacatgcagactcaacagatgtcgggggagaaaactctgagattgggccccgggcagagcctgtttccttttcccctgtccctttcacataagccccacactgcagaacttggagtcagtggttcatggggacccaaggacatccacagaagaccgaagtacctgatagagcaggaacagatgcacgtcagactacgaccagcttgaacccttggggacctgtatccatccccttcccttgagtccagcctaatcacagccacagaatgaatccatgacccggaaggacatttaaggacctctggcccaactctccccacgcaacagtgggattgcctctgcttgtttgaataccactatggagggggaacttgctacatttaaaggttgctgaatttttttgttttgttttgggagatggagtctctctctgtcgcccaggctggagtgcagtggtgtgatctcgacccactgcaacctccgcttcctgggttcaagcgattttcatgcctcagcctccctagtagctgggactacaggtgtgggccaccacacctggctaatttttgtatttttagtagagacggggtttcaccatgttgcccaggctggtctcaaactcccgacctcaggtgatctgcctgccttggcctcccaaagtgttgggattacaggcttgagccacaccacccggcaaaggttgcctaattctatctcagggcaagtctgttcatgtgggctgaaatctgtctctcatacctgcccttaaataagcttctgtttttctggtcctttctgtctgagatgactttaattcctcccccgaccccatctcatgaggctcagcttagatgtttccttctcttcctccctgatggctgcgtgcagaagctcatacctgcaatcccagcactttgggaggccgaggtgggaggattgcttgggcccaggagttctaggccagcctagcaacacagcaagaccctctctctacaaaaaattaaaaattagccaggtgtggtggcttgtgcctgtgggcccacctactcaggaggctgaggtgagaggatctcttgagtctgggaggtggaggctgcagtgagccatgatctcactccagcctgggcgtcagagtgagacctgtctcaaaaaaacaaaaaccaaagttttccttaacttgcaatcctccacccatctcctgacctccaccccaggccgaccctcctctgggatcacacggaagcctgggcccagaatcttacagtctaccttggaaatccttcagattttgcctccaactcctctttccatacaagttacatattaactcaatcaatgcttattggatgccttctgagttaccaggatgctgctggaggcctgtgctgctgagagggacaaatagaatcctgatatgactggaaccaggaatagggccaccatcagctctagaacccagggagcaaatggcaggagcaacaccaggcagtcggccctcagcccagcacagacctggtgtgttggcttcagaaaatcctggaaacatctctgctgtgtttggagctcctattctgtgagaagtgttttataggctttgctccatttaatccttacgataacccaataggacatactattaatgatcccctttttttcagaccggaaaactgaggttcggagacattaagtaatttgcctaaagtcacacagccacatcctgtaggacttggaattatgaactcaggtctatctgaattttaaagcctggatttttccccctttgctacatgcctgggaagaaccatgtattgacaatgaagaatcctaaactctcgttaa

SEQ ID NO: 231 - protein, 202 aa, Homo sapiens
MMQDVSSSPVSPADDSLSNSEEEPDRQQPPSGKRGGRKRRSSRRSAGGGAGPGGAAGGGVGGGDEPGSPAQGKRGKKSAGCGGGGGAGGGGGSSSGGGSPQSYEELQTQRVMANVRERQRTQSLNEAFAALRKIIPTLPSDKLSKIQTLKLAARYIDFLYQVLQSDELDSKMASCSYVAHERLSYAFSVWRMEGAWSMSASH

SEQ ID NO: 232 - DNA, 1629 bp, Homo sapiens
aactcccagacacctcgcgggctctgcagcaccggcaccgtttccaggaggcctggcggggtgtgcgtccagccgttgggcgctttctttttggacctcggggccatccacaccgtcccctccccctcccgcctccctccccgcctcccccgcgcgccctccccgcggaggtccctcccgtccgtcctcctgctctctcctccgcgggccgcatcgcccgggccggcgccgcgcgcgggggaagctggcgggctgaggcgccccgctcttctcctctgccccgggcccgcgaggccacgcgtcgccgctcgagagatgatgcaggacgtgtccagctcgccagtctcgccggccgacgacagcctgagcaacagcgaggaagagccagaccggcagcagccgccgagcggcaagcgcgggggacgcaagcggcgcagcagcaggcgcagcgcgggcggcggcgcggggcccggcggagccgcgggtgggggcgtcggaggcggcgacgagccgggcagcccggcccagggcaagcgcggcaagaagtctgcgggctgtggggcggcggcggcgcgggcggcggcggcggcagcagcagcggcggcgggagtccgcagtcttacgaggagctgcagacgcagcgggtcatggccaacgtgcgggagcgccagcgcacccagtcgctgaacgaggcgttcgccgcgctgcggaagatcatccccacgctgccctcggacaagctgagcaagattcagaccctcaagctggcggccaggtacatcgacttcctctaccaggtcctccagagcgacgagctggactccaagatggcaagctgcagctatgtggctcacgagcggctcagctacgccttctcggtctggaggatggagggggcctggtccatgtccgcgtcccactagcaggcggagccccccaccccctcagcagggccggagacctagatgtcattgtttccagagaaggagaaaatggacagtctagagactctggagctggataactaaaaataaaaatatatgccaaagattttcttggaaattagaagagcaaaatccaaattcaaagaaacagggcgtggggcgcacttttaaaagagaaagcgagacaggcccgtggacagtgattcccagacgggcagcggcaccatcctcacacctctgcattctgatagaagtctgaacagttgtttgtgttttttttttttttttttttgacgaagaatgtttttatttttatttttttcatgcatgcattctcaagaggtcgtgccaatcagccactgaaaggaaaggcatcactatggactttctctattttaaaatggtaacaatcagaggaactataagaacacctttagaaataaaaatactgggatcaaactggcctgcaaaaccatagtcagttaattctttttttcatccttcctctgaggggaaaaacaaaaaaaaacttaaaatacaaaaaacaacattctatttatttattgaggacccatggtaaaatgcaaatagatccggtgtctaaatgcattcatatttttatgattgttttgtaaatatctttgtatatttttctgcaataaataaatataaaaaatttagagaa

SEQ ID NO: 233 - protein, 160 aa, Homo sapiens
MEEGSSSPVSPVDSLGTSEEELERQPKRFGRKRRYSKKSSEDGSPTPGKRGKKGSPSAQSFEELQSQRILANVRERQRTQSLNEAFAALRKIIPTLPSDKLSKIQTLKLAARYIDFLYQVLQSDEMDNKMTSCSYVAHERLSYAFSVWRMEGAWSMSASH

SEQ ID NO: 234 - DNA, 1342 bp, Homo sapiens
gcacaagccggccttgaaatcagagcctttccagcaactccgagagcgtgtgctcggcgaccgcgggcttggccagcggcgcgcgctcggcgccccggcgcccccagccccacgcgcgccgggcgggcgccatggaggagggctccagctcgcccgtgtcccccgtggacagcctgggcaccagcgaggaggagctcgagaggcagcccaagcgcttcggccggaagcggcgctacagcaagaagtcgagcgaagatggcagcccgaccccgggcaagcgcggcaagaagggcagccccagcgcgcagtccttcgaggagctgcagagccagcgcatcctggccaacgtgcgcgagcgccagcgcacccagtcgctcaacgaggccttcgcggcgctgcgcaagatcatccccacgctgccctctgacaagctgagcaagatccagacgctcaagctggccgccaggtacatagacttcctctaccaggtcctgcagagcgacgagatggacaataagatgaccagctgcagctacgtggcccacgagcgcctcagctacgccttctccgtgtggcgcatggagggcgcgtggtccatgtccgcctcccactagcgccgcgccacccacctccggaccggcgcgccagggctgtccgtcgcgtcggcggcgcaagtggaattgggatgcattcgagtctgtaacttctgaaacctgaacaacctcaggaggcccccacctctgccctccaccagcgtcgagagaagggacagcagtgacatcggacagaagacccgggctcccgtcctcccccaggacggtccccacataggaagggcactcccagccctcttgctggtgacattgtcatggtcatcttgtttctgtttggatttttcttctgggtcttatgtttggggggaggtttattctttctgaaaatgtctagattcaggaacacatttatgaggatttggattttgaatttgtatttccctctaagtgccttttttaatgtctatttttttaataaaacagaaatgcattcttgtacaattctgttgaaactggaccaaggctctcagaagaggacccccgagttccttcccctcccccgagcctctgcatgattgtttcaagtcagcctggaattcttactttcacgccgctattcttttcctttctccgtgattgcttggctagccatttaaaaaaaaatattctctgttcagtgtatatgttgcttgtttgttttatttattgagatatttttacaagctaagtgactgcagtgtggctgtgtatcctgctccccacccaggaaaaataaagacgtccgcgca

SEQ ID NO: 235 - protein, 778 aa, Homo sapiens
MAQKMDCGAGLLGFQAEASVEDSALLMQTLMEAIQISEAPPTNQATAAASPQSSQPPTANEMADIQVSAAAARPKSAFKVQNATTKGPNGVYDFSQAHNAKDVPNTQPKAAFKSQNATPKGPNAAYDFSQAATTGELAANKSEMAFKAQNATTKVGPNATYNFSQSLNANDLANSRPKTPFKAWNDTTKAPTADTQTQNVNQAKMATSQADIETDPGISEPDGATAQTSADGSQAQNLESRTIIRGKRTRKINNLNVEENSSGDQRRAPLAAGTWRSAPVPVTTQNPPGAPPNVLWQTPLAWQNPSGWQNQTARQTPPARQSPPARQTPPAWQNPVAWQNPVIWPNPVIWQNPVIWPNPIVWPGPVVWPNPLAWQNPPGWQTPPGWQTPPGWQGPPDWQGPPDWPLPPDWPLPPDWPLPTDWPLPPDWIPADWPIPPDWQNLRPSPNLRPSPNSRASQNPGAAQPRDVALLQERANKLVKYLMLKDYTKVPIKRSEMLRDIIREYTDVYPEIIERACFVLEKKFGIQLKEIDKEEHLYILISTPESLAGILGTTKDTPKLGLLLVILGVIFMNGNRASEAVLWEALRKMGLRPGVRHPLLGDLRKLLTYEFVKQKYLDYRRVPNSNPPEYEFLWGLRSYHETSKMKVLRFIAEVQKRDPRDWTAQFMEAADEALDALDAAAAEAEARAEARTRMGIGDEAVSGPWSWDDIEFELLTWDEEGDFGDPWSRIPFTFWARYHQNARSRFPQTFAGPIIGPGGTASANFAANFGAIGFFWVE

SEQ ID NO: 236 - DNA, 2632 bp, Homo sapiens
agcacttccggtcacgccatcgttgctgccttcttcgtcaagcccccaggctccgctcttgccagagggacaggagccatggctcagaaaatggactgtggtgcgggcctcctcggcttccaggctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctaggcctaagtcagcctttaaagtccagaatgccaccacaaaaggcccaaatggtgtctatgatttctctcaggctcataatgccaaggatgtgcccaacacgcagcccaaggcagcctttaagtcccaaaatgctaccccaaagggtccaaatgctgcctatgatttttcccaggcagcaaccactggtgagttagctgctaacaagtctgagatggccttcaaggcccagaatgccactactaaagtgggcccaaatgccacctacaatttctctcagtctctcaatgccaatgacctggccaacagcaggcctaagacccctttcaaggcttggaatgataccactaaggccccaacagctgatacccagacccagaatgtaaatcaggccaaaatggccacttcccaggctgacatagagaccgacccaggtatctctgaacctgacggtgcaactgcacagacatcagcagatggttcccaggctcagaatctggagtcccggacaataattcggggcaagaggacccgcaagattaataacttgaatgttgaagagaacagcagtggggatcagaggcgggccccactggctgcagggacctggaggtctgcaccagttccagtgaccactcagaacccacctggcgcaccccccaatgtgctctggcagacgccattggcttggcagaacccctcaggctggcaaaaccagacagccaggcagaccccaccagcacgtcagagccctccagctaggcagaccccaccagcctggcagaacccagtcgcttggcagaacccagtgatttggccaaacccagtaatctggcagaacccagtgatctggccaaaccccattgtctggcccggccctgttgtctggccgaatccactggcctggcagaatccacctggatggcagactccacctggatggcagaccccaccgggctggcagggtcctccagactggcaaggtcctcctgactggccgctaccacccgactggccactgccacctgattggccacttcccactgactggccactaccacctgactggatccccgctgattggccaattccacctgactggcagaacctgcgcccctcgcctaacctgcgcccttctcccaactcgcgtgcctcacagaacccaggtgctgcacagccccgagatgtggcccttcttcaggaaagagcaaataagttggtcaagtacttgatgcttaaggactacacaaaggtgcccatcaagcgctcagaaatgctgagagatatcatccgtgaatacactgatgtttatccagaaatcattgaacgtgcatgctttgtcctagagaagaaatttgggattcaactgaaagaaattgacaaagaagaacacctgtatattctcatcagtacccccgagtccctggctggcatactgggaacgaccaaagacacacccaagctcggtctcctcttggtgattctgggtgtcatcttcatgaatggcaaccgtgccagtgaggctgtcctctgggaggcactacgcaagatgggactgcgtcctggggtgagacatcccctccttggagatctaaggaaacttctcacctatgagtttgtaaagcagaaatacctggactacagacgagtgcccaacagcaaccccccggagtatgagttcctctggggcctccgttcctaccatgagactagcaagatgaaagtgctgagattcattgcagaggttcagaaaagagaccctcgtgactggactgcacagttcatggaggctgcagatgaggccttggatgctctggatgctgctgcagctgaggccgaagcccgggctgaagcaagaacccgcatgggaattggagatgaggctgtgtctgggccctggagctgggatgacattgagtttgagctgctgacctgggatgaggaaggagattttggagatccctggtccagaattccatttaccttctgggccagataccaccagaatgcccgctccagattccctcagacctttgccggtcccattattggtcctggtggtacagccagtgccaacttcgctgccaactttggtgccattggtttcttctgggttgagtgagatgttggatattgctatcaatcgcagtagtctttcccctgtgtgaggctgaagcctcagattccttctaaacacagctatctagagagccacatcctgttgactgaaagtggcatgcaagataaatttatttgctgttccttgtctactgctttttttccccttgtgtgctgtcaagttttggtatcagaaataaacattgaaattgcaaagtgaa

SEQ ID NO: 237 - protein, 733 aa, Homo sapiens
MERRSESPCLRDSPDRRSGSPDVKGPPPVKVARLEQNGSPMGARGRPNGAVAKAVGGLMIPVFCVVEQLDGSLEYDNREEHAEFVLVRKDVLFSQLVETALLALGYSHSSAAQAQGIIKLGRWNPLPLSYVTDAPDATVADMLQDVYHVVTLKIQLQSCSKLEDLPAEQWNHATVRNALKELLKEMNQSTLAKECPLSQSMISSIVNSTYYANVSATKCQEFGRWYKKYKKIKVERVERENLSDYCVLGQRPMHLPNMNQLASLGKTNEQSPHSQIHHSTPIRNQVPALQPIMSPGLLSPQLSPQLVRQQIAMAHLINQQIAVSRLLAHQHPQAINQQFLNHPPIPRAVKPEPTNSSVEVSPDIYQQVRDELKRASVSQAVFARVAFNRTQGLLSEILRKEEDPRTASQSLLVNLRAMQNFLNLPEVERDRIYQDERERSMNPNVSMVSSASSSPSSSRTPQAKTSTPTTDLPIKVDGANINITAAIYDEIQQEMKRAKVSQALFAKVAANKSQGWLCELLRWKENPSPENRTLWENLCTIRRFLNLPQHERDVIYEEESRHHHSERMQHVVQLPPEPVQVLHRQQSQPAKESSPPREEAPPPPPPTEDSCAKKPRSRTKISLEALGILQSFIHDVGLYPDQEAIHTLSAQLDLPKHTIIKFFQNQRYHVKHHGKLKEHLGSAVDVAEYKDEELLTESEENDSEEGSEEMYKVEAEEENADKSKAAPAEIDQR

SEQ ID NO: 238 - DNA, 5567 bp, Homo sapiens
gagtccggctctggctgctggcagaggcggccgagaggggagaggctggaggtgacagcttgggcggccgccgcgtttcctcccgcgcgcggtcccgggtccctgcgtcttctcggctcttggtgttaccggtcccaccgctctggccgcgcctcctcgcgagctagccgccctgcgaaccagcagccccggctcgccgccgccgccgccgcctccgggttctcagccctttctctccagaacgggtctccttcccgaaggtgtgaaaaggctctttcagcctccttctcttcccccctcctccgccgtcccctcccccgctcgctcgggtgtccctttggaggagtcctttccctctcctcctcctccccctcctccctccccccatcatcatcataacaaccatctccgcaccagaagaagacaccctgacccaggaccttaaacattaggacctggggaagagggaaggggaaggagtaaagaggaagactaggagaacactgcaaagccaagcaccagaaactttccaccctggattctctacttttgctccatggacagagccccagtcagccaagtttcagacagaccgtgagcagtccctgtgcgttttattgcgacctgccggtgggaactttgtctccgagtcggagcagcatggagcggcggagcgagagcccgtgtctgcgggacagccccgaccggcggagcggcagcccggacgtcaaggggcctcccccagtgaaggtggcccggctggagcagaacggcagccccatgggagcccgcgggaggcccaacggcgccgtggccaaggccgtgggaggtttgatgattcctgtcttttgtgtcgtggagcagttggacggctctcttgaatatgacaacagagaagaacacgccgagtttgtcctggtgcggaaagatgtgctttttagccagctggtggagactgcgctcctggccctggggtattctcacagctctgcggcccaggcccaaggaataatcaagctgggaaggtggaaccctctccccctcagttatgtgacagatgcacccgacgcgacagtggccgacatgctacaagatgtctatcatgttgtgacgttgaaaatccaattacaaagttgttcaaagttggaagacttgcctgcggagcagtggaaccatgccacagtccgcaatgccttaaaggaactgctcaaagagatgaaccagagcacattagccaaagaatgccctctctcccagagtatgatttcatccattgtaaatagcacatattatgccaatgtgtcagcaaccaagtgccaggagtttgggagatggtataaaaagtacaagaagattaaagtggaaagagtggaacgagaaaacctttcagactattgtgttctgggccagcgtccaatgcatttaccaaatatgaaccagctggcatccctggggaaaaccaacgaacagtctcctcacagccaaattcaccacagtactccaatccgaaaccaagtgcccgcattacagcccatcatgagccctggtcttctttctccccagcttagtccacaacttgtaaggcaacaaatagccatggcccatctgataaaccaacagattgccgttagccggctcctggctcaccagcatcctcaagccatcaaccagcagttcctgaaccatccacccatccccagagcagttaagccagagccaaccaactcttccgtggaagtctctccagatatctaccagcaagtcagagatgagctgaagagggccagtgtgtcccaagctgtctttgcaagagtggcattcaaccgcacacagggattgttgtctgagattctgcgtaaggaagaagaccctcggacagcctctcagtctcttctagtaaacctgagggccatgcagaatttcctcaatctgccagaagtggagcgagatcgcatctaccaggatgagagggagcggagcatgaatcccaatgtgagcatggtctcctcggcctccagcagtcccagctcctcccgaacccctcaggccaaaacctcgacaccgacaacagacctccctattaaggtggacggcgccaacatcaacatcacagctgccatttatgacgagatccaacaggagatgaaaagggccaaggtgtctcaagccctgtttgccaaagtggctgcaaataaaagtcagggctggctgtgtgaactgctccgctggaaggagaacccaagcccagaaaaccgcaccctctgggaaaacctctgtaccatccgtcgcttcctgaaccttccccagcatgagagggatgtcatctatgaggaggagtcaaggcatcaccacagcgaacgcatgcaacacgtggtccagcttccccctgagccggtgcaggtacttcatagacagcagtctcagccagccaaggagagttcccctcccagagaagaagcgcctcccccacctcctccgactgaagacagttgtgccaaaaagccccggtctcgcacaaagatctccttagaagccctggggatcctccaaagctttattcatgatgtaggcctgtacccagaccaggaagccatccacactctttcggctcagctggatctccccaaacacaccatcatcaagttcttccagaaccagcggtaccacgtgaagcaccacgggaagctgaaagagcacctgggctccgcggtggacgtggctgaatataaggacgaggagctgctgaccgagtcagaggagaacgacagcgaggaaggctccgaggagatgtacaaagtggaggctgaggaggaaaatgctgacaaaagcaaggcagcacctgccgaaattgaccagagataatgtgaacttctactaggcaaagcaatacatcggtccaaggattttctgctttcatttctttaaaagttttttgttagtttgttttttgtttttgtttttgggtttttttggctttatttttgtctttttatgtctgttttgtttttcttacccttttggacatttctttgttgcacaggatacacctatagactgaataagttcagtatttccgaatcagacatcgccttggcaaagacactaaagcgttacactttatcccgtctctatgactggatcatagtcattataatcacaggagactctgccttcattatccttgcacttaacggaagttacatcaggcaagtaccaggatgaaaagaactatgaaataaatgaaggaagctacaagtgtgtgtgtatatgtatatgtatatatctctatatttacatatatatattaaaattgcatgggacagagactttgcaatccgaaagaatagactgtgaaatgagttcttaaagaaaagacttgtttatgtattaaaaaaaccacttcacagtgagtcgctttggctttttgataaactgcggcctgctctcagggtggggtgactatttttgaattcctatttattttttgtgtttgtccctgattttttttttttaattctatggcttcctatctggcagcttaatgggtaatttttgaggtatgtatttaacaaaataaacgacactgccgaaaaaaaaaaaagtgaagtgaaaacaatcagggcacattaaaatgatacaagtcaaataaatcttaaagacacaatgcacacttaaaatgactcaataaaatgacttgctacgttccgttattcaatttgtcattactgtagtgaacagatgcatttctgtggaattccaaataagtaaaactgaaattcagtgcagagaaaactttgtccactagtgcaagtcttgatcaaatgacattttgacattggacatatggaattcatagtatgagccacattttgttgtgaaatttatttacctgcttgtggcttcaaatctgaaaattaataagcctgctcgtttaaaagttgtttgttgttgctgtttttttgtctttttgttttttactagaaaatagttcagtgtaatattaagttagaaaagaagttgctgcccagttaaaggggctccctctcaaataaatctccatccttccctctcccaaaagacatttctgatttctgcttcactttgggcttcctcttcttcgtacacattccatctacctaatcaaacattttcagtccctgatctctcctgtcccttttcctgggatgacagccctaacaagaactgtttttgaatcgttgtgcagctccaggcaatagagtatgtgaagcgatttcagtagaatcacttactcatcctaaaagaaaacattatcccagttacctacatcgcaattaccttatgtaaagcagaactaatgctgactggatgtttaatgggatgagcattaaagctgcaatctactatagtactccagatctctttcggcttcctatgagaaacaccagaagcattactttccacttctacttacagtaattgcaagaggagacctcacattcaggactgcctagtgaacgtaatccatgctttaaactggccattaaacagtcccacatggttggattttttttttttttttgagttgtgctttcacaaaaccttgtcaaagacctcatgcaatatcactttgaaagttattttctgtttactacacaaacattgtaatataactgttaatactatttatatatttgaaaggtataaaaggtaggagttaaaaaaaaaacctctatgtgtagatattaactcagaacttacaatatacagggagaagacatgttgcaatacaagctaattctagctgctcagtaacctctggagtttttaaagggacattttcctgtactttttcaaataatgatgtttaaaaattatcttgacataagcgtcatatacctttgcaaaaggatggttgtttgcagttagccctggccccatccttcctatttctgtagtatgctgcagctttaatcagaaagtccatggttgctgcttcctgatctccgagttactctttccaaattgtcttcttacactgttgctgaaggtcactctgtacacgtaatggaaactgattttgccaagctcttacaaggtggttcatctatcgatggcatccgcatttggtatcttttacacttcaaccaaaaatttattaggtatttttcaatgctaagtcttgccttttattttttaatttcactgccaagtttgcagtggttctaagtgaatctgtgggcattttagcctgtggtcttgccagatctttgcgaattacaatgcatatatgtctatttattcaatatctgtcatataatatctatttggaagaagaaactttctcttgtagtgcctcttgacaaagcacaatttcccgcctttttttttttttgtgaaatgaaaaaaacaaattgtgttttattgcggtatcaacaatgtgaataaggattaacatattgtaaatgttcttttttccatgtaaatcaactatctttgttatcactaagtgataattaatttttaacttatgtgcattgttaggctgttagaattttttggttgttaaaataaacgcattcaataaa

SEQ ID NO: 239 - protein, 457 aa, Homo sapiens
MDSFKVVLEGPAPWGFRLQGGKDFNVPLSISRLTPGGKAAQAGVAVGDWVLSIDGENAGSLTHIEAQNKIRACGERLSLGLSRAQPVQSKPQKASAPAADPPRYTFAPSVSLNKTARPFGAPPPADSAPQQNGQPLRPLVPDASKQRLMENTEDWRPRPGTGQSRSFRILAHLTGTEFMQDPDEEHLKKSSQVPRTEAPAPASSTPQEPWPGPTAPSPTSRPPWAVDPAFAERYAPDKTSTVLTRHSQPATPTPLQSRTSIVQAAAGGVPGGGSNNGKTPVCHQCHKVIRGRYLVALGHAYHPEEFVCSQCGKVLEEGGFFEEKGAIFCPPCYDVRYAPSCAKCKKKITGEIMHALKMTWHVHCFTCAACKTPIRNRAFYMEEGVPYCERDYEKMFGTKCHGCDFKIDAGDRFLEALGFSWHDTCFVCAICQINLEGKTFYSKKDRPLCKSHAFSHV

SEQ ID NO: 240 - DNA, 1712 bp, Homo sapiens
gtcagaacactggcggccgatcccaacgaggctccctggagcccgacgcagagcagcgccctggccgggccaagcaggagccggcatcatggattccttcaaagtagtgctggaggggccagcaccttggggcttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaaccgcagaaggcctccgcccccgccgcggaccctccgcggtacacctttgcacccagcgtctccctcaacaagacggcccggccctttggggcgcccccgcccgctgacagcgccccgcagcagaatggacagccgctccgaccgctggtcccagatgccagcaagcagcggctgatggagaacacagaggactggcggccgcggccggggacaggccagtcgcgttccttccgcatccttgcccacctcacaggcaccgagttcatgcaagacccggatgaggagcacctgaagaaatcaagccaggtgcccaggacagaagccccagccccagcctcatctacaccccaggagccctggcctggccctaccgcccccagccctaccagccgcccgccctgggctgtggaccctgcgtttgccgagcgctatgccccggacaaaacgagcacagtgctgacccggcacagccagccggccacgcccacgccgctgcagagccgcacctccattgtgcaggcagctgccggaggggtgccaggagggggcagcaacaacggcaagactcccgtgtgtcaccagtgccacaaggtcatccggggccgctacctggtggcgctgggccacgcgtaccacccggaggagtttgtgtgtagccagtgtgggaaggtcctggaagagggtggcttctttgaggagaagggcgccatcttctgcccaccatgctatgacgtgcgctatgcacccagctgtgccaagtgcaagaagaagattacaggcgagatcatgcacgccctgaagatgacctggcacgtgcactgctttacctgtgctgcctgcaagacgcccatccggaacagggccttctacatggaggagggcgtgccctattgcgagcgagactatgagaagatgtttggcacgaaatgccatggctgtgacttcaagatcgacgctggggaccgcttcctggaggccctgggcttcagctggcatgacacctgcttcgtctgtgcgatatgtcagatcaacctggaaggaaagaccttctactccaagaaggacaggcctctctgcaagagccatgccttctctcatgtgtgagccccttctgcccacagctgccgcggtggcccctagcctgaggggcctggagtcgtggccctgcatttctgggtagggctggcaatggttgccttaaccctggctcctggcccgagcctggggctccctgggccctgccccacccaccttatcctcccaccccactccctccaccaccacagcacaccggtgctggccacaccagccccctttcacctccagtgccacaataaacctgtacccagctgtg

SEQ ID NO: 241 - protein, 190 aa, Homo sapiens
MGVLFGKVFSQTTICRFEALQLSFKNMCKLRPLLQKWVEEADNNENLQEICKAETLVQARKRKRTSIENRVRGNLENLFLQCPKPTLQQISHIAQQLGLEKDVVRVWFCNRRQKGKRSSSDYAQREDFEAAGSPFSGGPVSFPLAPGPHFGTPGYGSPHFTALYSSVPFPEGEAFPPVSVTTLGSPMHSN

SEQ ID NO: 242 - DNA, 1589 bp, Homo sapiens
ggaaaaaaggaaagtgcacttggaagagatccaagtgggcaacttgaagaacaagtgccaaatagcacttctgtcatgctggatgtcagggctctttgtccactttgtatagccgctggcttatagaaggtgctcgataaatctcttgaatttaaaaatcaattaggatgcctctatagtgaaaaagatacagtaaagatgagggataatcaatttaaaaaatgagtaagtacacacaaagcactttatccattcttatgacacctgttacttttttgctgtgtttgtgtgtatgcatgccatgttatagtttgtgggaccctcaaagcaagctggggagagtatatactgaatttagcttctgagacatgatgctcttcctttttaattaacccagaacttagcagcttatctatttctctaatctcaaaacatccttaaactgggggtgatacttgagtgagagaattttgcaggtattaaatgaactatcttcttttttttttttctttgagacagagtcttgctctgtcacccaggctggagtgcagtggcgtgatctcagctcactgcaacctccgcctcccgggttcaagtgattctcctgcctcagcctcctgagtagctgggattacagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctccgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcctgggacacagtagatagacacacttaaaaaaaaaaa

SEQ ID NO: 243 - protein, 513 aa, Homo sapiens
MRQPPGESDMAVSDALLPSFSTFASGPAGREKTLRQAGAPNNRWREELSHMKRLPPVLPGRPYDLAAATVATDLESGGAGAACGGSNLAPLPRRETEEFNDLLDLDFILSNSLTHPPESVAATVSSSASASSSSSPSSSGPASAPSTCSFTYPIRAGNDPGVAPGGTGGGLLYGRESAPPPTAPFNLADINDVSPSGGFVAELLRPELDPVYIPPQQPQPPGGGLMGKFVLKASLSAPGSEYGSPSVISVSKGSPDGSHPVVVAPYNGGPPRTCPKIKQEAVSSCTHLGAGPPLSNGHRPAAHDFPLGRQLPSRTTPTLGLEEVLSSRDCHPALPLPPGFHPHPGPNYPSFLPDQMQPQVPPLHYQGQSRGFVARAGEPCVCWPHFGTHGMMLTPPSSPLELMPPGSCMPEEPKPKRGRRSWPRKRTATHTCDYAGCGKTYTKSSHLKAHLRTHTGEKPYHCDWDGCGWKFARSDELTRHYRKHTGHRPFQCQKCDRAFSRSDHLALHMKRHF

SEQ ID NO: 244 - DNA, 3038 bp, Homo sapiens
ggcagtttcccgaccagagagaacgaacgtgtctgcgggcgcgcggggagcagaggcggtggcgggcggcggcggcaccgggagccgccgagtgaccctcccccgcccctctggccccccaccctcccacccgcccgtggcccgcgcccatggccgcgcgcgctccacacaactcaccggagtccgcgccttgcgccgccgaccagttcgcagctccgcgccacggcagccagtctcacctggcggcaccgcccgcccaccgccccggccacagcccctgcgcccacggcagcactcgaggcgaccgcgacagtggtgggggacgctgctgagtggaagagagcgcagcccggccaccggacctacttactcgccttgctgattgtctatttttgcgtttacaacttttctaagaacttttgtatacaaaggaactttttaaaaaagacgcttccaagttatatttaatccaaagaagaaggatctcggccaatttggggttttgggttttggcttcgtttcttctcttcgttgactttggggttcaggtgccccagctgcttcgggctgccgaggaccttctgggcccccacattaatgaggcagccacctggcgagtctgacatggctgtcagcgacgcgctgctcccatctttctccacgttcgcgtctggcccggcgggaagggagaagacactgcgtcaagcaggtgccccgaataaccgctggcgggaggagctctcccacatgaagcgacttcccccagtgcttcccggccgcccctatgacctggcggcggcgaccgtggccacagacctggagagcggcggagccggtgcggcttgcggcggtagcaacctggcgcccctacctcggagagagaccgaggagttcaacgatctcctggacctggactttattctctccaattcgctgacccatcctccggagtcagtggccgccaccgtgtcctcgtcagcgtcagcctcctcttcgtcgtcgccgtcgagcagcggccctgccagcgcgccctccacctgcagcttcacctatccgatccgggccgggaacgacccgggcgtggcgccgggcggcacgggcggaggcctcctctatggcagggagtccgctccccctccgacggctcccttcaacctggcggacatcaacgacgtgagcccctcgggcggcttcgtggccgagctcctgcggccagaattggacccggtgtacattccgccgcagcagccgcagccgccaggtggcgggctgatgggcaagttcgtgctgaaggcgtcgctgagcgcccctggcagcgagtacggcagcccgtcggtcatcagcgtcagcaaaggcagccctgacggcagccacccggtggtggtggcgccctacaacggcgggccgccgcgcacgtgccccaagatcaagcaggaggcggtctcttcgtgcacccacttgggcgctggaccccctctcagcaatggccaccggccggctgcacacgacttccccctggggcggcagctccccagcaggactaccccgaccctgggtcttgaggaagtgctgagcagcagggactgtcaccctgccctgccgcttcctcccggcttccatccccacccggggcccaattacccatccttcctgcccgatcagatgcagccgcaagtcccgccgctccattaccaaggtcagtcccggggatttgtagctcgggctggggagccctgtgtgtgctggccccacttcgggacacacgggatgatgctcaccccaccttcttcacccctagagctcatgccacccggttcctgcatgccagaggagcccaagccaaagaggggaagacgatcgtggccccggaaaaggaccgccacccacacttgtgattacgcgggctgcggcaaaacctacacaaagagttcccatctcaaggcacacctgcgaacccacacaggtgagaaaccttaccactgtgactgggacggctgtggatggaaattcgcccgctcagatgaactgaccaggcactaccgtaaacacacggggcaccgcccgttccagtgccaaaaatgcgaccgagcattttccaggtcggaccacctcgccttacacatgaagaggcatttttaaatcccagacagtggatatgacccacactgccagaagagaattcagtattttttacttttcacactgtcttcccgatgagggaaggagcccagccagaaagcactacaatcatggtcaagttcccaactgagtcatcttgtgagtggataatcaggaaaaatgaggaatccaaaagacaaaaatcaaagaacagatggggtctgtgactggatcttctatcattccaattctaaatccgacttgaatattcctggacttacaaaatgccaagggggtgactggaagttgtggatatcagggtataaattatatccgtgagttgggggagggaagaccagaattcccttgaattgtgtattgatgcaatataagcataaaagatcaccttgtattctctttaccttctaaaagccattattatgatgttagaagaagaggaagaaattcaggtacagaaaacatgtttaaatagcctaaatgatggtgcttggtgagtcttggttctaaaggtaccaaacaaggaagccaaagttttcaaactgctgcatactttgacaaggaaaatctatatttgtcttccgatcaacatttatgacctaagtcaggtaatatacctggtttacttctttagcatttttatgcagacagtctgttatgcactgtggtttcagatgtgcaataatttgtacaatggtttattcccaagtatgccttaagcagaacaaatgtgtttttctatatagttccttgccttaataaatatgtaatataaatttaagcaaacgtctattttgtatatttgtaaactacaaagtaaaatgaacattttgtggagtttgtattttgcatactcaaggtgagaattaagttttaaataaacctataatattttatctgaa

SEQ ID NO: 245 - protein, 453 aa, Homo sapiens
MDFFRVVENQPPATMPLNVSFTNRNYDLDYDSVQPYFYCDEEENFYQQQQQSELQPPAPSEDIWKKFELLPTPPLSPSRRSGLCSPSYVAVTPFSLRGDNDGGGGSFSTADQLEMVTELLGGDMVNQSFICDPDDETFIKNIIIQDCMWSGFSAAAKLVSEKLASYQAARKDSGSPNPARGHSVCSTSSLYLQDLSAAASECIDPSVVFPYPLNDSSSPKSCASQDSSAFSPSSDSLLSSTESSPQGSPEPLVLHEETPPTTSSDSEEEQEDEEEIDVVSVEKRQAPGKRSESGSPSAGGHSKPPHSPLVLKRCHVSTHQHNYAAPPSTRKDYPAAKRVKLDSVRVLRQISNNRKCTSPRSSDTEENVKRRTHNVLERQRRNELKRSFFALRDQIPELENNEKAPKVVILKKATAYILSVQAEEQKLISEEDLLRKRREQLKHKLEQLRNSCA

SEQ ID NO: 246 - DNA, 4515 bp, Homo sapiens
ggagtttattcataacgcgctctccaagtatacgtggcaatgcgttgctgggttattttaatcattctaggcatcgttttcctccttatgcctctatcattcctccctatctacactaacatcccacgctctgaacgcgcgcccattaatacccttctttcctccactctccctgggactcttgatcaaagcgcggccctttccccagccttagcgaggcgccctgcagcctggtacgcgcgtggcgtggcggtgggcgcgcagtgcgttctcggtgtggagggcagctgttccgcctgcgatgatttatactcacaggacaaggatgcggtttgtcaaacagtactgctacggaggagcagcagagaaagggagagggtttgagagggagcaaaagaaaatggtaggcgcgcgtagttaattcatgcggctctcttactctgtttacatcctagagctagagtgctcggctgcccggctgagtctcctccccaccttccccaccctccccaccctccccataagcgcccctcccgggttcccaaagcagagggcgtgggggaaaagaaaaaagatcctctctcgctaatctccgcccaccggccctttataatgcgagggtctggacggctgaggacccccgagctgtgctgctcgcggccgccaccgccgggccccggccgtccctggctcccctcctgcctcgagaagggcagggcttctcagaggcttggcgggaaaaagaacggagggagggatcgcgctgagtataaaagccggttttcggggctttatctaactcgctgtagtaattccagcgagaggcagagggagcgagcgggcggccggctagggtggaagagccgggcgagcagagctgcgctgcgggcgtcctgggaagggagatccggagcgaatagggggcttcgcctctggcccagccctcccgctgatcccccagccagcggtccgcaacccttgccgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcctcccgcgacgatgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaaggaaaagtaaggaaaacgattccttctaacagaaatgtcctgagcaatcacctatgaacttgtttcaaatgcatgatcaaatgcaacctcacaaccttggctgagtcttgagactgaaagatttagccataatgtaaactgcctcaaattggactttgggcataaaagaacttttttatgcttaccatcttttttttttctttaacagatttgtatttaagaattgtttttaaaaaattttaagatttacacaatgtttctctgtaaatattgccattaaatgtaaataactttaataaaacgtttatagcagttacacagaatttcaatcctagtatatagtacctagtattataggtactataaaccctaattttttttatttaagtacattttgctttttaaagttgatttttttctattgtttttagaaaaaataaaataactggcaaatatatcattgagccaaatcttaagttgtgaatgttttgtttcgtttcttccccctcccaaccaccaccatccctgtttgttttcatcaattgccccttcagagggtggtcttaagaaaggcaagagttttcctctgttgaaatgggtctgggggccttaaggtctttaagttcttggaggttctaagatgcttcctggagactatgataacagccagagttgacagttagaaggaatggcagaaggcaggtgagaaggtgagaggtaggcaaaggagatacaagaggtcaaaggtagcagttaagtacacaaagaggcataaggactggggagttgggaggaaggtgaggaagaaactcctgttactttagttaaccagtgccagtcccctgctcactccaaacccaggaattctgcccagttgatggggacacggtgggaaccagcttctgctgccttcacaaccaggcgccagtcctgtccatgggttatctcgcaaaccccagaggatctctgggaggaatgctactattaaccctatttcacaaacaaggaaatagaagagctcaaagaggttatgtaacttatctgtagccacgcagataatacaaagcagcaatctggacccattctgttcaaaacacttaacccttcgctatcatgccttggttcatctgggtctaatgtgctgagatcaagaaggtttaggacctaatggacagactcaagtcataacaatgctaagctctatttgtgtcccaagcactcctaagcattttatccctaactctacatcaaccccatgaaggagatactgttgatttccccatattagaagtagagagggaagctgaggcacacaaagactcatccacatgcccaagattcactgatagggaaaagtggaagcgagatttgaacccaggctgtttactcctaacctgtccaagccacctctcagacgacggtaggaatcagctggctgcttgtgagtacaggagttacagtccagtgggttatgttttttaagtctcaacatctaagcctggtcaggcatcagttcccctttttttgtgatttattttgtttttattttgttgttcattgtttaatttttccttttacaatgagaaggtcaccatcttgactcctaccttagccatttgttgaatcagactcatgacggctcctgggaagaagccagttcagatcataaaataaaacatatttattctttgtcatgggagtcattattttagaaactacaaactctccttgcttccatccttttttacatactcatgacacatgctcatcctgagtccttgaaaaggtatttttgaacatgtgtattaattataagcctctgaaaacctatggcccaaaccagaaatgatgttgattatataggtaaatgaaggatgctattgctgttctaattacctcattgtctcagtctcaaagtaggtcttcagctccctgtactttgggattttaatctaccaccacccataaatcaataaataattactttctttga

SEQ ID NO: 247 - protein, 287 aa, Homo sapiens
MSGSFDRKLSSILTDISSSLSCHAGSKDSPTLPESSVTDLGYYSAPQHDYYSGQPYGQTVNPYTYHHQFNLNGLAGTGAYSPKSEYTYGASYRQYGAYREQPLPAQDPVSVKEEPEAEVRMVNGKPKKVRKPRTIYSSYQLAALQRRFQKAQYLALPERAELAAQLGLTQTQVKIWFQNRRSKFKKLYKNGEVPLEHSPNNSDSMACNSPPSPALWDTSSHSTPAPARSQLPPPLPYSASPSYLDDPTNSWYHAQNLSGPHLQQQPPQPATLHHASPGPPPNPGAVY

SEQ ID NO: 248 - DNA, 2602 bp, Homo sapiens
agcatttgattgtggcttgggacgcgaggagaggcgcgcagcgaccgcctgacggcaggcaatggtgtaagcgcctctcggcctccccctccccccagacgcggccgggtcctcccttcgccttctggacacacacccctgcctcgtctcttccgcctctctcgcactccggtccgttcctgtcctctgcggaggccagccctggggaggtgcagcgcccgccaggatgagtggctccttcgatcgcaagctcagcagcatcctcaccgacatctccagctcccttagctgccatgcgggctccaaggactcgcctaccctgcccgagtcttctgtcactgacctgggctactacagcgctccccagcacgattactactcgggccagccctatggccagacggtgaacccctacacctaccaccaccaattcaatctcaatgggcttgcaggcacgggcgcttactcgcccaagtcggaatatacctacggagcctcctaccggcaatacggggcgtatcgggagcagccgctgccagcccaggacccagtgtcggtgaaggaggagccggaagcagaggtgcgcatggtgaatgggaagcccaagaaggtccgaaagccgcgtacgatctactccagctaccagctggccgccctgcagcgccgcttccagaaggcccagtacctggcgctgcccgagcgcgccgagctggccgcgcagctgggcctcacgcagacacaggtgaaaatctggttccagaaccgccgttccaagttcaagaaactctacaagaacggggaggtgccgctggagcacagtcccaataacagtgattccatggcctgcaactcaccaccatcacccgccctctgggacacctcttcccactccactccggcccctgcccgcagtcagctgcccccgccgctcccatacagtgcctcccccagctacctggacgaccccaccaactcctggtatcacgcacagaacctgagtggaccccacttacagcagcagccgcctcagccagccaccctgcaccatgcctctcccgggcccccgcccaaccctggggctgtgtactgagcacccatctggcctgcacccttgacaaaggaccccaggaccaggcagaaggcgcctccgtcctagccactcaggaatcatcgaggagcacagggaaaaggaactccctttccccctcccttgccccttcctccagggacccaagcgcttccagatgacaattgcatggaccaaggatgccccctgaacctccctccctctgcctagacactggggtacccctccagatgtggggacattccaccccagtggggacagccattcccctacctgctccaggagcctggattggctttaaatggctcatcatcttccagcttcttaaacttagtgcctgttcccagactggagaccttgggatgggggagagtgtggagggtttgcgggtcctgcctgtgctggggcacctggcaccgtggatcttaaaacttgccaggcctagttcctcctgagcctctggtggtctccccctgctcgagcggcccctcggccaataagacagtggacatcatgacgaggactccgggtggggacctgaactggtcaccgccctgcacttctagccctcatttaagatttgagggtgaaaccaaagaaaaccccctaagtgagggaatcttttaatatttgtggctttagaggaaagaactaaaggagccatctctctcccctctcctccgttccgagaggaggggtgggtctcagacgtttttcctatggacttatttcttccatgtccaggactttgcacaactttggttttaaaagctgttgaaaaataggaaaacaaagggcattgttcacagatagggccaagtctccccttgcaagggtgcctctgttctgtccctgcccccacctcaccttctctactcctccagtaagttggcagttttggtgccaaaccccaaatctccaaagagacataccaggcaagacaaacccccaaacacctcctttccggtggccttggaaacagattgctccgagctggagaatgtcgggtgaggtgtatgggagaggaggggagagttagaacttgtgcctttgggagtaaggggtaactgcctggagggctggtggcactgcccctccctgacccagacatcccaccaaagctaactttcccccacccctgatgcagtaaaacattgaaaaaaaaaaaaaaggagaggtagaagactgtagctatatatataaatatatagtaagttttttttttttaagagcaacagagagaagcagcctcctccctgctgcggtttcctatttatgtggccatgttcctcctggacggatctccctgtgtgtttcaagctgagagatgtgggctccggctggatttgggttttgtgggaggtgcaggggccaagagagacgtggtaggtctccaagagtcccacccgggggggaagaagcaaagccatctcccaccccctcccagccttctcatttctgctttcttactggactcatctttatatataatgttaataaaaaagacgaaaataa

SEQ ID NO: 249 - protein, 289 aa, Homo sapiens
MTGVFDRRVPSIRSGDFQAPFQTSAAMHHPSQESPTLPESSATDSDYYSPTGGAPHGYCSPTSASYGKALNPYQYQYHGVNGSAGSYPAKAYADYSYASSYHQYGGAYNRVPSATNQPEKEVTEPEVRMVNGKPKKVRKPRTIYSSFQLAALQRRFQKTQYLALPERAELAASLGLTQTQVKIWFQNKRSKIKKIMKNGEMPPEHSPSSSDPMACNSPQSPAVWEPQGSSRSLSHHPHAHPPTSNQSPASSYLENSASWYTSAASSINSHLPPPGSLQHPLALASGTLY

SEQ ID NO: 250 - DNA, 1418 bp, Homo sapiens
agcagtcagccggccggagacagagacttcacgactcccagtctcctcctcgccgcggccgccgcctcctccttctctcctcctcctcttcctcctcctccctcgctcccacagccatgtctgcttagaccagagcagccccacagccaactagggcagctgccgccgccacaacagcaaggacagccgctgccgccgcccgtgagcgatgacaggagtgtttgacagaagggtccccagcatccgatccggcgacttccaagctccgttccagacgtccgcagctatgcaccatccgtctcaggaatcgccaactttgcccgagtcttcagctaccgattctgactactacagccctacggggggagccccgcacggctactgctctcctacctcggcttcctatggcaaagctctcaacccctaccagtatcagtatcacggcgtgaacggctccgccgggagctacccagccaaagcttatgccgactatagctacgctagctcctaccaccagtacggcggcgcctacaaccgcgtcccaagcgccaccaaccagccagagaaagaagtgaccgagcccgaggtgagaatggtgaatggcaaaccaaagaaagttcgtaaacccaggactatttattccagctttcagctggccgcattacagagaaggtttcagaagactcagtacctcgccttgccggaacgcgccgagctggccgcctcgctgggattgacacaaacacaggtgaaaatctggtttcagaacaaaagatccaagatcaagaagatcatgaaaaacggggagatgcccccggagcacagtcccagctccagcgacccaatggcgtgtaactcgccgcagtctccagcggtgtgggagccccagggctcgtcccgctcgctcagccaccaccctcatgcccaccctccgacctccaaccagtccccagcgtccagctacctggagaactctgcatcctggtacacaagtgcagccagctcaatcaattcccacctgccgccgccgggctccttacagcacccgctggcgctggcctccgggacactctattagatgggctgctctctcttactctcttttttgggactactgtgttttgctgttctagaaaatcataaagaaaggaattcatatggggaagttcggaaaactgaaaaagattcatgtgtaaagcttttttttgcatgtaagttattgcatttcaaaagaccccccctttttttacagaggactttttttgcgcaactgtggacactttcaatggtgccttgaaatctatgacctcaacttttcaaaagacttttttcaatgttattttagccatgtaaataagtgtagatagaggaattaaactgtatattctggataaataaaattatttcgaccatgaaaa

SEQ ID NO: 251 - protein, 293 aa, Homo sapiens
MMTMTTMADGLEGQDSSKSAFMEFGQQQQQQQQQQQQQQQQQQQPPPPPPPPPQPHSQQSSPAMAGAHYPLHCLHSAAAAAAAGSHHHHHHQHHHHGSPYASGGGNSYNHRSLAAYPYMSHSQHSPYLQSYHNSSAAAQTRGDDTDQQKTTVIENGEIRFNGKGKKIRKPRTIYSSLQLQALNHRFQQTQYLALPERAELAASLGLTQTQVKIWFQNKRSKFKKLLKQGSNPHESDPLQGSAALSPRSPALPPVWDVSASAKGVSMPPNSYMPGYSHWYSSPHQDTMQRPQMM

SEQ ID NO: 252 - DNA, 2230 bp, Homo sapiens
attcgactcgtggcgtctgcatcaagtctgaaagcagacgcgcaactttcgcagaatccaccttaaaatctctgccttaaactgcaccagcccccaaaaaatccaaggggggaaagcaggcggggggagagcagattcccccctccccctctcctctcccatccctcctccttcctcctccctttgagttaacaaggccccgctcactatatctctttatattaaatatatatatatattagagaagagcgagggagagggagaaccacctccacccccctctttaaattcttttttttttttttttttttttttgcaaggatccaaagagctaaggtggctgcagaggggagagcggcgcgagccaagtgggggagggtggaggaaacccgggagaaggctttctccagcccccaaagtttttgatgatgaccatgactacgatggctgacggcttggaaggccaggactcgtccaaatccgccttcatggagttcgggcagcagcagcagcagcagcagcaacagcagcagcagcagcagcagcaacagcaacagccgccgccgccgccgccgccgccgccgcagccgcactcgcagcagagctccccggccatggcaggcgcgcactaccctctgcactgcctgcactcggcggcggcggcggcagcggccggctcgcaccaccaccaccaccaccagcaccaccaccacggctcgccctacgcgtcgggcggagggaactcctacaaccaccgctcgctcgccgcctacccctacatgagccactcgcagcacagcccttacctccagtcctaccacaacagcagcgcagccgcccagacgcgaggggacgacacagatcaacaaaaaactacagtgattgaaaacggggaaatcaggttcaatggaaaagggaaaaagattcggaagcctcggaccatttattccagcctgcagctccaggctttaaaccatcgctttcagcagacacagtatctggcccttccagagagagccgaactggcagcttccttaggactgacacaaacacaggtgaagatatggtttcagaacaaacgctctaagtttaagaaactgctgaagcagggcagtaatcctcatgagagcgaccccctccagggctcggcggccctgtcgccacgctcgccagcgctgcctccagtctgggacgtttctgcctcggccaagggtgtcagtatgccccccaacagctacatgcctggctattctcactggtactcctctccacaccaggacacgatgcagagaccacagatgatgtgagttgcccaagggaacaccctagggaaacgtctgaacaaggaaaagaggatccgggacctgcttgtatctgcgaaaaggagccaaaggagcaggcttaggagagctcataagtgtggcaagaagccgactaggctcattctctctccctctctctctctctccctctcctttctttttacttcttcctttcctccattccttctttctttccttttcctttctacctttcttttctttttgcctttcaccttttttctcatttaccttctctcttgagcaacgtcagtaattgatcttgcatctcagagagagagaaagagcatgtgtgagagagaaactggtttctatgccagcactcctgaaaccccttactgtaaggatattttctcttaccccttgggatccaggctctgagtctcttctctttgggagtatccatcaaaatgactttttttaaaaacagattttcccccaaccagaagaatctgcacaaacttggcagcgtttttacttgtttaatgagtttaagacattacatggtgaaagagaagcattttggactcctgcatttttatttaccattcccagactgacgagaaaaagaaaattcctcacataacagcccttctctaaagaaaaaggaaaaagtggctttgattaaaaaaaaacaaaacaaaaaccactctttccccaccccacccccccaaaccctgaactggaatcaggaaagacggaggaaacaatcaaaatcaccattctattgctttgacacctttactaggtgaattggtggcattcacaaagctaatagggacgtttatatcaagaaacatttctgtatatattgttgaattttagttgtacatatactttgtatgtttttgtcttctttcatatatggagtaaaagccacaaaacgctga

SEQ ID NO: 253 - protein, 73 aa, Homo sapiens
MSAETASGPTEDQVEILEYNFNKVDKHPDSTTLCLIAAEAGLSEEETQKWFKQRLAKWRRSEGLPSECRSVTD

SEQ ID NO: 254 - DNA, 1198 bp, Homo sapiens
gagacagaaggccgcctaccggggaggccggaggccggctagtcgcggactcgggcgaacccaccctcgcgatctgtcaagtctgtccccaggggaggtccccctttcgggaggaagtttttaaggggatttctcaaaatcacccccgcgcttccttcactccttccttagagccggaggtcggtgagggcccgcggaatcatctatctcgcccccgtcgcagcgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtcctgctgtttaacacagtgttgtattttttttctaaatgtacataattagaaaagaaaataacaataggaagctatgtgtatcttctgtgtaaagcagtggcttcactggaaaaatggtgtggctagcatttccctttgagtcatgatgacagatggtgtgaaaaccatctaagtttgcttttgaccatcacctcccagtagcaatttgctttcataatccatttagcaatccaggcctctgttgaaaagataatatgagggagaagggaacacatttccttctgaacttacttccctaagtcactttccttatgtatcatctaatacaatgatggttgagtgaaaatacagaaggggtgtttgagtattcagatttcataaaacacttccttggaatatagctgcattaacttggaaagaagcctgttgggccagaagacagaaactccaactggcaaaaaagcaagcatctaagaaaaaaaaccaccaaagttcttgaatttactatatttaaatgcattggttaagtttattttgctaaataaagtgaactgctttttgtctctaaaatgatattctaaataaaaccttaactttttgttgaagatgcactgaaaaaaaaaa

SEQ ID NO: 255 - protein, 239 aa, Homo sapiens
MPGGAHGPPPGYGCAAAGYLDGRLEPLYERVGAPALRPLVIKQEPREEDEAKQLALAGLFPYQPPPPPPPSHPHPHPPPAHLAAPHLQFQIAHCGQTTMHLQPGHPTPPPTPVPSPHPAPALGAAGLPGPGSALKGLGAAHPDLRASGGSGAGKAKKSVDKNSNEYRVRRERNNIAVRKSRDKAKQRNVETQQKVLELTSDNDRLRKRVEQLSRELDTLRGIFRQLPESSLVKAMGNCA

SEQ ID NO: 256 - DNA, 2631 bp, Homo sapiens
tataaaagctgggccggcgcgggccgggccattcgcgacccggaggtgcgcgggcgcgggcgagcagggtctccgggtgggcggcggcgacgccccgcgcaggctggaggccgccgaggctcgccatgccgggagaactctaactcccccatggagtcggccgacttctacgaggcggagccgcggcccccgatgagcagccacctgcagagccccccgcacgcgcccagcagcgccgccttcggctttccccggggcgcgggccccgcgcagcctcccgccccacctgccgccccggagccgctgggcggcatctgcgagcacgagacgtccatcgacatcagcgcctacatcgacccggccgccttcaacgacgagttcctggccgacctgttccagcacagccggcagcaggagaaggccaaggcggccgtgggccccacgggcggcggcggcggcggcgactttgactacccgggcgcgcccgcgggccccggcggcgccgtcatgcccgggggagcgcacgggcccccgcccggctacggctgcgcggccgccggctacctggacggcaggctggagcccctgtacgagcgcgtcggggcgccggcgctgcggccgctggtgatcaagcaggagccccgcgaggaggatgaagccaagcagctggcgctggccggcctcttcccttaccagccgccgccgccgccgccgccctcgcacccgcacccgcacccgccgcccgcgcacctggccgccccgcacctgcagttccagatcgcgcactgcggccagaccaccatgcacctgcagcccggtcaccccacgccgccgcccacgcccgtgcccagcccgcaccccgcgcccgcgctcggtgccgccggcctgccgggccctggcagcgcgctcaaggggctgggcgccgcgcaccccgacctccgcgcgagtggcggcagcggcgcgggcaaggccaagaagtcggtggacaagaacagcaacgagtaccgggtgcggcgcgagcgcaacaacatcgcggtgcgcaagagccgcgacaaggccaagcagcgcaacgtggagacgcagcagaaggtgctggagctgaccagtgacaatgaccgcctgcgcaagcgggtggaacagctgagccgcgaactggacacgctgcggggcatcttccgccagctgccagagagctccttggtcaaggccatgggcaactgcgcgtgaggcgcgcggctgtgggaccgccctgggccagcctccggcggggacccagggagtggtttggggtcgccggatctcgaggcttgcccgagccgtgcgagccaggactaggagattccggtgcctcctgaaagcctggcctgctccgcgtgtcccctcccttcctctgcgccggacttggtgcgtctaagatgagggggccaggcggtggcttctccctgcgaggaggggagaattcttggggctgagctgggagcccggcaactctagtatttaggataaccttgtgccttggaaatgcaaactcaccgctccaatgcctactgagtagggggagcaaatcgtgccttgtcattttatttggaggtttcctgcctccttcccgaggctacagcagacccccatgagagaaggaggggagcaggcccgtggcaggaggagggctcagggagctgagatcccgacaagcccgccagccccagccgctcctccacgcctgtccttagaaaggggtggaaacatagggacttggggcttggaacctaaggttgttcccctagttctacatgaaggtggagggtctctagttccacgcctctcccacctccctccgcacacaccccaccccagcctgctataggctgggcttccccttggggcggaactcactgcgatgggggtcaccaggtgaccagtgggagcccccaccccgagtcacaccagaaagctaggtcgtgggtcagctctgaggatgtatacccctggtgggagagggagacctagagatctggctgtggggcgggcatggggggtgaagggccactgggaccctcagccttgtttgtactgtatgccttcagcattgcctaggaacacgaagcacgatcagtccatcccagagggaccggagttatgacaagctttccaaatattttgctttatcagccgatatcaacacttgtatctggcctctgtgccccagcagtgccttgtgcaatgtgaatgtgcgcgtctctgctaaaccaccattttatttggtttttgttttgttttggttttgctcggatacttgccaaaatgagactctccgtcggcagctgggggaagggtctgagactccctttccttttggttttgggattacttttgatcctgggggaccaatgaggtgaggggggttctcctttgccctcagctttccccagcccctccggcctgggctgcccacaaggcttgtcccccagaggccctggctcctggtcgggaagggaggtggcctcccgccaacgcatcactggggctgggagcagggaaggacggcttggttctcttcttttggggagaacgtagagtctcactctagatgttttatgtattatatctataatataaacatatcaaagtcaa

SEQ ID NO: 257 - protein, 351 aa, Homo sapiens
MTEMSFLSSEVLVGDLMSPFDQSGLGAEESLGLLDDYLEVAKHFKPHGFSSDKAKAGSSEWLAVDGLVSPSNNSKEDAFSGTDWMLEKMDLKEFDLDALLGIDDLETMPDDLLTTLDDTCDLFAPLVQETNKQPPQTVNPIGHLPESLTKPDQVAPFTFLQPLPLSPGVLSSTPDHSFSLELGSEVDITEGDRKPDYTAYVAMIPQCIKEEDTPSDNDSGICMSPESYLGSPQHSPSTRGSPNRSLPSPGVLCGSARPKPYDPPGEKMVAAKVKGEKLDKKLKKMEQNKTAATRYRQKKRAEQEALTGECKELEKKNEALKERADSLAKEIQYLKDLIEEVRKARGKKRVP

SEQ ID NO: 258 - DNA, 2041 bp, Homo sapiens
agccatttctactttgcccgcccacagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgtgagtaccggggcgggtcgtccagctgtgctcctggggccggcgcgggttttggattggtggggtgcggcctggggccagggcggtgccgccaagggggaagcgatttaacgagcgcccgggacgcgtggtctttgcttgggtgtccccgagacgctcgcgtgcctgggatcgggaaagcgtagtcgggtgcccggactgcttccccaggagccctacagccctcggaccccgagccccgcaagggtcccaggggtcttggctgttgccccacgaaacgtggcaggaaccaagatggcggcggcagggcggcggcgcgggcgtgagtcaagggcgggcggtgggcggggcgcggccgccctggccgtatttggacgtggggacggagcgctttcctcttggcggccggtggaagaatcccctggtctccgtgagcgtccattttgtggaacctgagttgcaagcagggaggggcaaatacaactgccctgttcccgattctctagatggccgatctagagaagtcccgcctcataagtggaaggatgaaattctcagaacagctaacctctaatgggagttggcttctgattctcattcaggcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaagtaaaaaaaaaaaaaaa

SEQ ID NO: 259 - protein, 465 aa, Homo sapiens
MNVTSLFSFTSPAVKRLLGWKQGDEEEKWAEKAVDALVKKLKKKKGAMEELEKALSCPGQPSNCVTIPRSLDGRLQVSHRKGLPHVIYCRVWRWPDLQSHHELKPLECCEFPFGSKQKEVCINPYHYKRVESPVLPPVLVPRHSEYNPQHSLLAQFRNLGQNEPHMPLNATFPDSFQQPNSHPFPHSPNSSYPNSPGSSSSTYPHSPTSSDPGSPFQMPADTPPPAYLPPEDPMTQDGSQPMDTNMMAPPLPSEINRGDVQAVAYEEPKHWCSIVYYELNNRVGEAFHASSTSVLVDGFTDPSNNKNRFCLGLLSNVNRNSTIENTRRHIGKGVHLYYVGGEVYAECLSDSSIFVQSRNCNYHHGFHPTTVCKIPSGCSLKIFNNQEFAQLLAQSVNHGFETVYELTKMCTIRMSFVKGWGAEYHRQDVTSTPCWIEIHLHGPLQWLDKVLTQMGSPHNPISSVS

SEQ ID NO: 260 - DNA, 2879 bp, Homo sapiens
cactgcatgtgtattcgtgagttcgcggttgaacaactgttcctttactctgctccctgtctttgtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccagggcaaccgagtaactgtgtcaccattccccgctctctggatggcaggctgcaagtctcccaccggaagggactgcctcatgtcatttactgccgtgtgtggcgctggcccgatcttcagagccaccatgaactaaaaccactggaatgctgtgagtttccttttggttccaagcagaaggaggtctgcatcaatccctaccactataagagagtagaaagccctgtacttcctcctgtgctggttccaagacacagcgaatataatcctcagcacagcctcttagctcagttccgtaacttaggacaaaatgagcctcacatgccactcaacgccacttttccagattctttccagcaacccaacagccacccgtttcctcactctcccaatagcagttacccaaactctcctgggagcagcagcagcacctaccctcactctcccaccagctcagacccaggaagccctttccagatgccagctgatacgcccccacctgcttacctgcctcctgaagaccccatgacccaggatggctctcagccgatggacacaaacatgatggcgcctcccctgccctcagaaatcaacagaggagatgttcaggcggttgcttatgaggaaccaaaacactggtgctctattgtctactatgagctcaacaatcgtgtgggtgaagcgttccatgcctcctccacaagtgtgttggtggatggtttcactgatccttccaacaataagaaccgtttctgccttgggctgctctccaatgttaaccggaattccactattgaaaacaccaggcggcatattggaaaaggagttcatctttattatgttggaggggaggtgtatgccgaatgccttagtgacagtagcatctttgtgcaaagtcggaactgcaactaccatcatggatttcatcctactactgtttgcaagatccctagtgggtgtagtctgaaaatttttaacaaccaagaatttgctcagttattggcacagtctgtgaaccatggatttgagacagtctatgagcttacaaaaatgtgtactatacgtatgagctttgtgaagggctggggagcagaataccaccgccaggatgttactagcaccccctgctggattgagatacatctgcacggccccctccagtggctggataaagttcttactcaaatgggttcacctcataatcctatttcatctgtatcttaaatggccccaggcatctgcctctggaaaactattgagccttgcatgtacttgaaggatggatgagtcagacacgattgagaactgacaaaggagccttgataatacttgacctctgtgaccaactgttggattcagaaatttaaacaaaaaaaaaaaaaaacacacacaccttggtaacatactgttgatatcaagaacctgtttagtttacattgtaacattctattgtaaaatcaactaaaattcagacttttagcaggactttgtgtacagttaaaggagagatggccaagccagggacaaattgtctattagaaaacggtcctaagagattctttggtgtttggcactttaaggtcatcgttgggcagaagtttagcattaatagttgttctgaaacgtgttttatcaggtttagagcccatgttgagtcttcttttcatgggttttcataatattttaaaactatttgtttagcgatggttttgttcgtttaagtaaaggttaatcttgatgatatacataataatctttctaaaattgtatgctgaccatacttgctgtcagaataatgctaggcatatgctttttgctaaatatgtatgtacagagtatttggaagttaagaattgattagactagtgaatttaggagtatttgaggtgggtggggggaagagggaaatgacaactgcaaatgtagactatactgtaaaaattcagtttgttgctttaaagaaacaaactgatacctgaattttgctgtgtttccattttttagagatttttatcatttttttctctctcggcattcttttttctcatactcttcaaaaagcagttctgcagctggttaattcatgtaactgtgagagcaaatgaataattcctgctattctgaaattgcctacatgtttcaataccagttatatggagtgcttgaatttaataagcagtttttacggagtttacagtacagaaataggctttaattttcaagtgaattttttgccaaacttagtaactctgttaaatatttggaggatttaaagaacatcccagtttgaattcatttcaaactttttaaatttttttgtactatgtttggttttattttccttctgttaatcttttgtattcacttatgctctcgtacattgagtacttttattccaaaactagtgggttttctctactggaaattttcaataaacctgtcattattgcttactttgattaaaa

SEQ ID NO: 261 - protein, 615 aa, Homo sapiens
MGLKAAQKTLFPLRSIDDVVRLFAAELGREEPDLVLLSLVLGFVEHFLAVNRVIPTNVPELTFQPSPAPDPPGGLTYFPVADLSIIAALYARFTAQIRGAVDLSLYPREGGVSSRELVKKVSDVIWNSLSRSYFKDRAHIQSLFSFITGWSPVGTKLDSSGVAFAVVGACQALGLRDVHLALSEDHAWVVFGPNGEQTAEVTWHGKGNEDRRGQTVNAGVAERSWLYLKGSYMRCDRKMEVAFMVCAINPSIDLHTDSLELLQLQQKLLWLLYDLGHLERYPMALGNLADLEELEPTPGRPDPLTLYHKGIASAKTYYRDEHIYPYMYLAGYHCRNRNVREALQAWADTATVIQDYNYCREDEEIYKEFFEVANDVIPNLLKEAASLLEAGEERPGEQSQGTQSQGSALQDPECFAHLLRFYDGICKWEEGSPTPVLHVGWATFLVQSLGRFEGQVRQKVRIVSREAEAAEAEEPWGEEAREGRRRGPRRESKPEEPPPPKKPALDKGLGTGQGAVSGPPRKPPGTVAGTARGPEGGSTAQVPAPAASPPPEGPVLTFQSEKMKGMKELLVATKINSSAIKLQLTAQSQVQMKKQKVSTPSDYTLSFLKRQRKGL

SEQ ID NO: 262 - DNA, 2785 bp, Homo sapiens
ggtgtccggagccgcggacctagagatcccagaagccacagcgcagcggcccggcccgccactatttccaggctcagcggggcaggggccgccgcccaccgcccgccgccatggggctgaaggccgcccagaagacgctgttcccgctgcgctccatcgacgacgtggtgcgcctgtttgctgccgagctgggccgagaggagccggacctggtgctcctttccttggtgctgggcttcgtggagcattttctggctgtcaaccgcgtcatccctaccaacgttcccgagctcaccttccagcccagccccgcccccgacccgcctggcggcctcacctactttcccgtggccgacctgtctatcatcgccgccctctatgcccgcttcaccgcccagatccgaggcgccgtcgacctgtccctctatcctcgagaagggggtgtctccagccgtgagctggtgaagaaggtctccgatgtcatatggaacagcctcagccgctcctacttcaaggatcgggcccacatccagtccctcttcagcttcatcacaggttggagcccagtaggcaccaaattggacagctccggtgtggcctttgctgtggttggggcctgccaggccctgggtctccgggatgtccacctcgccctgtctgaggatcatgcctgggtagtgtttgggcccaatggggagcagacagctgaggtcacctggcacggcaagggcaacgaggaccgcaggggccagacagtcaatgccggtgtggctgagcggagctggctgtacctgaaaggatcatacatgcgctgtgaccgcaagatggaggtggcgttcatggtgtgtgccatcaacccttccattgacctgcacaccgactcgctggagcttctgcagctgcagcagaagctgctctggctgctctatgacctgggacatctggaaaggtaccccatggccttagggaacctggcagatctagaggagctggagcccacccctggccggccagacccactcaccctctaccacaagggcattgcctcagccaagacctactatcgggatgaacacatctacccctacatgtacctggctggctaccactgtcgcaaccgcaatgtgcgggaagccctgcaggcctgggcggacacggccactgtcatccaggactacaactactgccgggaagacgaggagatctacaaggagttctttgaagtagccaatgatgtcatccccaacctgctgaaggaggcagccagcttgctggaggcgggcgaggagcggccgggggagcaaagccagggcacccagagccaaggttccgccctccaggaccctgagtgcttcgcccacctgctgcgattctacgacggcatctgcaaatgggaggagggcagtcccacgcctgtgctgcacgtgggctgggccacctttcttgtgcagtccctaggccgttttgagggacaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccgcagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgctccagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagagggttaggagtgggtgacaagagcctgatctcttcctgttttgtacatagatttatttttcagttccaagaaagatgaatacattttgttaaaaaaaataaaaaaaa

SEQ ID NO: 263 - protein, 303 aa, Homo sapiens
MAPAADMTSLPLGVKVEDSAFGKPAGGGAGQAPSAAAATAAAMGADEEGAKPKVSPSLLPFSVEALMADHRKPGAKESALAPSEGVQAAGGSAQPLGVPPGSLGAPDAPSSPRPLGHFSVGGLLKLPEDALVKAESPEKPERTPWMQSPRFSPPPARRLSPPACTLRKHKTNRKPRTPFTTAQLLALERKFRQKQYLSIAERAEFSSSLSLTETQVKIWFQNRRAKAKRLQEAELEKLKMAAKPMLPPAAFGLSFPLGGPAAVAAAAGASLYGASGPFQRAALPVAPVGLYTAHVGYSMYHLT

SEQ ID NO: 264 - DNA, 1940 bp, Homo sapiens
agggcccggagccggcgagtgctcccgggaactctgcctgcgcggcggcagcgaccggaggccaggcccagcacgccggagctggcctgctggggaggggcgggaggcgcgcgcgggagggtccgcccggccagggccccgggcgctcgcagaggccggccgcgctcccagcccgcccggagcccatgcccggcggctggccagtgctgcggcagaagggggggcccggctctgcatggccccggctgctgacatgacttctttgccactcggtgtcaaagtggaggactccgccttcggcaagccggcggggggaggcgcgggccaggcccccagcgccgccgcggccacggcagccgccatgggcgcggacgaggagggggccaagcccaaagtgtccccttcgctcctgcccttcagcgtggaggcgctcatggccgaccacaggaagccgggggccaaggagagcgccctggcgccctccgagggcgtgcaggcggcgggtggctcggcgcagccactgggcgtcccgccggggtcgctgggagccccggacgcgccctcttcgccgcggccgctcggccatttctcggtggggggactcctcaagctgccagaagatgcgctcgtcaaagccgagagccccgagaagcccgagaggaccccgtggatgcagagcccccgcttctccccgccgccggccaggcggctgagccccccagcctgcaccctccgcaaacacaagacgaaccgtaagccgcggacgcccttcaccaccgcgcagctgctggcgctggagcgcaagttccgccagaagcagtacctgtccatcgccgagcgcgcggagttctccagctcgctcagcctcactgagacgcaggtgaagatatggttccagaaccgccgcgccaaggcaaagagactacaagaggcagagctggagaagctgaagatggccgccaagcccatgctgccaccggctgccttcggcctctccttccctctcggcggccccgcagctgtagcggccgcggcgggtgcctcgctctacggtgcctctggccccttccagcgcgccgcgctgcctgtggcgcccgtgggactctacacggcccatgtgggctacagcatgtaccacctgacatagagggtcccaggtcgcccacctgtgggccagccgattcctccagccctggtgctgtacccccgacgtgctcccctgctcggcaccgccagccgccttccctttaaccctcacactgctccagtttcacctctttgctccctgagttcactctccgaagtctgatccctgccaaaaagtggctggaagagtcccttagtactcttctagcatttagatctacactctcgagttaaagatggggaaactgagggcagagaggttaacagatttatctaaggtccccagcagaattgacagttgaacagagctagaggccatgtctcctgcatagcttttccctgtcctgacaccaggcaagaaaagcgcagagaaatcggtgtctgacgattttggaaatgagaacaatctcaaaaaaaaaaaaaaaaaaaaaaaaaaaaaaaaaaaagaaaagagaaaaaaaagactagccagccaggaagatgaatcctagcttcttccattggaaaatttaagacaagttcaacaacaaaacatttgctctggggggcagggaaaacacagatgtgttgcaaaggtaggttgaagggacctctctcttaccagtaccagaaacacaattgtaaaattaaaaaaaaaaaaaaactctttctatttaacagtacatttgtgtggctctcaaacatccctttggaagggattgtgtgtactatgtaatatactgtatatttgaaattttattatcatttatattatagctatatttgttaaataaattaattttaagctacaaaaa

SEQ ID NO: 265 - protein, 134 aa, Homo sapiens
MASPSKGNDLFSPDEEGPAVVAGPGPGPGGAEGAAEERRVKVSSLPFSVEALMSDKKPPKEASPLPAESASAGATLRPLLLSGHGAREAHSPGPLVKPFETASVKSENSEDGAAWMQEPGRYSPPPSECAPGQE

SEQ ID NO: 266 - DNA, 2224 bp, Homo sapiens
gcagcaaaaaagtttgagtcgccgctgccgggttgccagcggagtcgcgcgtcgggagctacgtagggcagagaagtcatggcttctccgtccaaaggcaatgacttgttttcgcccgacgaggagggcccagcagtggtggccggaccaggcccggggcctgggggcgccgagggggccgcggaggagcgccgcgtcaaggtctccagcctgcccttcagcgtggaggcgctcatgtccgacaagaagccgcccaaggaggcgtccccgctgccggccgaaagcgcctcggccggggccaccctgcggccactgctgctgtcggggcacggcgctcgggaagcgcacagccccgggccgctggtgaagcccttcgagaccgcctcggtcaagtcggaaaattcagaagatggagcggcgtggatgcaggaacccggccgatattcgccgccgccaagtgagtgcgcgccggggcaggagtaggaggacatatgagccctaccacctgcaccctgaggaaacacaagaccaatcggaagccgcgcacgccctttaccacatcccagctcctcgccctggagcgcaagttccgtcagaaacagtacctctccattgcagagcgtgcagagttctccagctctctgaacctcacagagacccaggtcaaaatctggttccagaaccgaagggccaaggcgaaaagactgcaggaggcagaactggaaaagctgaaaatggctgcaaaacctatgctgccctccagcttcagtctccctttccccatcagctcgcccctgcaggcagcgtccatatatggagcatcctacccgttccatagacctgtgcttcccatcccgcctgtgggactctatgccacgccagtgggatatggcatgtaccacctgtcctaaggaagaccagatcaatagactccatgatggatgcttgtttcaaagggtttcctctccctctccacgaaggcagtaccagccagtactcctgctctgctaaccctgcgtgcaccaccctaagcggctaggctgacagggccacacgacatagctgaaatttgttctgtaggcggaggcaccaagccctgttttcttggtgtaatcttccagatgcccccttttcctttcacaaagattggctctgatggtttttatgtataaatatatatatataataaaatataatacatttttatacagcagacgtaaaaattcaaattattttaaaaggcaaaatttatatacatatgtgctttttttctatatctcaccttcccaaaagacactgtgtaagtccatttgttgtattttcttaaagagggagacaaattatttgcaaaatgtgctaaagtcaatgatttttacgggattattgacttctgcttatggaaaacaaagaaacagacacaatgcacacagaaaatattagatatggagagattattcaaagtgaaggggacacatcatatttctgcattttacttgcattaaaagaaacctctttatatactacagttgttcctatctctcccccgccccccaccgccccaccacacacatatttttaaagtttttccttttttaagaatatttttgtaagaccaatacctgggatgagaagaatcctgagactgcctggaggtgaggtagaaaattagaaatacttcctaattcttctcaaggctgttggtaactttatttcagataattggagagtaaaatgttaaaacctgttgagaggaattgatggtttctgagaaatactaggtacattcatcctcacagattgcaaaggtgatttgggtgggggtttagtaattttctgcttaaaaaatgagtatcttgtaaccattacctatatgctaaatattcttgaacaattagtagatccagaaagaaaaaaaaatatgctttctctgtgtgtgtacctgttgtatgtcctaaacttattagaaaattttatatacttttttacatgttggggggcagaaggtaaagccatgttttgacttggtgaaaatgggattgtcaaacagcccattaagttccctggtatttcaccttcctgtccatctgtcccctccctccggtatacctttatccctttgaaagggtgcttgtacaatttgatatattttattgaagagttatctcttattctgaattaaattaagcatttgttttattgcagtaaagtttgtccaaactcacaa

SEQ ID NO: 267 - protein, 2818 aa, Homo sapiens
MAAHRPVEWVQAVVSRFDEQLPIKTGQQNTHTKVSTEHNKECLINISKYKFSLVISGLTTILKNVNNMRIFGEAAEKNLYLSQLIILDTLEKCLAGQPKDTMRLDETMLVKQLLPEICHFLHTCREGNQHAAELRNSASGVLFSLSCNNFNAVFSRISTRLQELTVCSEDNVDVHDIELLQYINVDCAKLKRLLKETAFKFKALKKVAQLAVINSLEKAFWNWVENYPDEFTKLYQIPQTDMAECAEKLFDLVDGFAESTKRKAAVWPLQIILLILCPEIIQDISKDVVDENNMNKKLFLDSLRKALAGHGGSRQLTESAAIACVKLCKASTYINWEDNSVIFLLVQSMVVDLKNLLFNPSKPFSRGSQPADVDLMIDCLVSCFRISPHNNQHFKICLAQNSPSTFHYVLVNSLHRIITNSALDWWPKIDAVYCHSVELRNMFGETLHKAVQGCGAHPAIRMAPSLTFKEKVTSLKFKEKPTDLETRSYKYLLLSMVKLIHADPKLLLCNPRKQGPETQGSTAELITGLVQLVPQSHMPEIAQEAMEALLVLHQLDSIDLWNPDAPVETFWEISSQMLFYICKKLTSHQMLSSTEILKWLREILICRNKFLLKNKQADRSSCHFLLFYGVGCDIPSSGNTSQMSMDHEELLRTPGASLRKGKGNSSMDSAAGCSGTPPICRQAQTKLEVALYMFLWNPDTEAVLVAMSCFRHLCEEADIRCGVDEVSVHNLLPNYNTFMEFASVSNMMSTGRAALQKRVMALLRRIEHPTAGNTEAWEDTHAKWEQATKLILNYPKAKMEDGQAAESLHKTIVKRRMSHVSGGGSIDLSDTDSLQEWINMTGFLCALGGVCLQQRSNSGLATYSPPMGPVSERKGSMISVMSSEGNADTPVSKFMDRLLSLMVCNHEKVGLQIRTNVKDLVGLELSPALYPMLFNKLKNTISKFFDSQGQVLLTDTNTQFVEQTIAIMKNLLDNHTEGSSEHLGQASIETMMLNLVRYVRVLGNMVHAIQIKTKLCQLVEVMMARRDDLSFCQEMKFRNKMVEYLTDWVMGTSNQAADDDVKCLTRDLDQASMEAVVSLLAGLPLQPEEGDGVELMEAKSQLFLKYFTLFMNLLNDCSEVEDESAQTGGRKRGMSRRLASLRHCTVLAMSNLLNANVDSGLMHSIGLGYHKDLQTRATFMEVLTKILQQGTEFDTLAETVLADRFERLVELVTMMGDQGELPIAMALANVVPCSQWDELARVLVTLFDSRHLLYQLLWNMFSKEVELADSMQTLFRGNSLASKIMTFCFKVYGATYLQKLLDPLLRIVITSSDWQHVSFEVDPTRLEPSESLEENQRNLLQMTEKFFHAIISSSSEFPPQLRSVCHCLYQVVSQRFPQNSIGAVGSAMFLRFINPAIVSPYEAGILDKKPPPRIERGLKLMSKILQSIANHVLFTKEEHMRPFNDFVKSNFDAARRFFLDIASDCPTSDAVNHSLSFISDGNVLALHRLLWNNQEKIGQYLSSNRDHKAVGRRPFDKMATLLAYLGPPEHKPVADTHWSSLNLTSSKFEEFMTRHQVHEKEEFKALKTLSIFYQAGTSKAGNPIFYYVARRFKTGQINGDLLIYHVLLTLKPYYAKPYEIVVDLTHTGPSNRFKTDFLSKWFVVFPGFAYDNVSAVYIYNCNSWVREYTKYHERLLTGLKGSKRLVFIDCPGKLAEHIEHEQQKLPAATLALEEDLKVFHNALKLAHKDTKVSIKVGSTAVQVTSAERTKVLGQSVFLNDIYYASEIEEICLVDENQFTLTIANQGTPLTFMHQECEAIVQSIIHIRTRWELSQPDSIPQHTKIRPKDVPGTLLNIALLNLGSSDPSLRSAAYNLLCALTCTFNLKIEGQLLETSGLCIPANNTLFIVSISKTLAANEPHLTLEFLEECISGFSKSSIELKHLCLEYMTPWLSNLVRFCKHNDDAKRQRVTAILDKLITMTINEKQMYPSIQAKIWGSLGQITDLLDVVLDSFIKTSATGGLGSIKAEVMADTAVALASGNVKLVSSKVIGRMCKIIDKTCLSPTPTLEQHLMWDDIAILARYMLMLSFNNSLDVAAHLPYLFHVVTFLVATGPLSLRASTHGLVINIIHSLCTCSQLHFSEETKQVLRLSLTEFSLPKFYLLFGISKVKSAAVIAFRSSYRDRSFSPGSYERETFALTSLETVTEALLEIMEACMRDIPTCKWLDQWTELAQRFAFQYNPSLQPRALVVFGCISKRVSHGQIKQIIRILSKALESCLKGPDTYNSQVLIEATVIALTKLQPLLNKDSPLHKALFWVAVAVLQLDEVNLYSAGTALLEQNLHTLDSLRIFNDKSPEEVFMAIRNPLEWHCKQMDHFVGLNFNSNFNFALVGHLLKGYRHPSPAIVARTVRILHTLLTLVNKHRNCDKFEVNTQSVAYLAALLTVSEEVRSRCSLKHRKSLLLTDISMENVPMDTYPIHHGDPSYRTLKETQPWSSPKGSEGYLAATYPTVGQTSPRARKSMSLDMGQPSQANTKKLLGTRKSFDHLISDTKAPKRQEMESGITTPPKMRRVAETDYEMETQRISSSQQHPHLRKVSVSESNVLLDEEVLTDPKIQALLLTVLATLVKYTTDEFDQRILYEYLAEASVVFPKVFPVVHNLLDSKINTLLSLCQDPNLLNPIHGIVQSVVYHEESPPQYQTSYLQSFGFNGLWRFAGPFSKQTQIPDYAELIVKFLDALIDTYLPGIDEETSEESLLTPTSPYPPALQSQLSITANLNLSNSMTSLATSQHSPGIDKENVELSPTTGHCNSGRTRHGSASQVQKQRSAGSFKRNSIKKIV

SEQ ID NO: 268 - DNA, 12380 bp, Homo sapiens
aatctctagctcgctcgcgctccctctccccgggccgtggaaaggatcccacttccggtggggtgtcatggcggcgtctcggactgtgatggctgtggggagacggcgctagtggggagagcgaccaagaggccccctcccctccccgggtccccttcccctatccccctccccccagcctccttgccaacgccccctttccctctccccctcccgctcggcgctgaccccccatccccacccccgtgggaacactgggagcctgcactccacagaccctctccttgcctcttccctcacctcagcctccgctccccgccctcttcccggcccagggcgccggcccacccttccctccgccgccccccggccgcggggaggacatggccgcgcacaggccggtggaatgggtccaggccgtggtcagccgcttcgacgagcagcttccaataaaaacaggacagcagaacacacataccaaagtcagtactgagcacaacaaggaatgtctaatcaatatttccaaatacaagttttctttggttataagcggcctcactactattttaaagaatgttaacaatatgagaatatttggagaagctgctgaaaaaaatttatatctctctcagttgattatattggatacactggaaaaatgtcttgctgggcaaccaaaggacacaatgagattagatgaaacgatgctggtcaaacagttgctgccagaaatctgccattttcttcacacctgtcgtgaaggaaaccagcatgcagctgaacttcggaattctgcctctggggttttattttctctcagctgcaacaacttcaatgcagtctttagtcgcatttctaccaggttacaggaattaactgtttgttcagaagacaatgttgatgttcatgatatagaattgttacagtatatcaatgtggattgtgcaaaattaaaacgactcctgaaggaaacagcatttaaatttaaagccctaaagaaggttgcgcagttagcagttataaatagcctggaaaaggcattttggaactgggtagaaaattatccagatgaatttacaaaactgtaccagatcccacagactgatatggctgaatgtgcagaaaagctatttgacttggtggatggttttgctgaaagcaccaaacgtaaagcagcagtttggccactacaaatcattctccttatcttgtgtccagaaataatccaggatatatccaaagacgtggttgatgaaaacaacatgaataagaagttatttctggacagtctacgaaaagctcttgctggccatggaggaagtaggcagctgacagaaagtgctgcaattgcctgtgtcaaactgtgtaaagcaagtacttacatcaattgggaagataactctgtcattttcctacttgttcagtccatggtggttgatcttaagaacctgctttttaatccaagtaagccattctcaagaggcagtcagcctgcagatgtggatctaatgattgactgccttgtttcttgctttcgtataagccctcacaacaaccaacactttaagatctgcctggctcagaattcaccttctacatttcactatgtgctggtaaattcactccatcgaatcatcaccaattccgcattggattggtggcctaagattgatgctgtgtattgtcactcggttgaacttcgaaatatgtttggtgaaacacttcataaagcagtgcaaggttgtggagcacacccagcaatacgaatggcaccgagtcttacatttaaagaaaaagtaacaagccttaaatttaaagaaaaacctacagacctggagacaagaagctataagtatcttctcttgtccatggtgaaactaattcatgcagatccaaagctcttgctttgtaatccaagaaaacaggggcccgaaacccaaggcagtacagcagaattaattacagggctcgtccaactggtccctcagtcacacatgccagagattgctcaggaagcaatggaggctctgctggttcttcatcagttagatagcattgatttgtggaatcctgatgctcctgtagaaacattttgggagattagctcacaaatgcttttttacatctgcaagaaattaactagtcatcaaatgcttagtagcacagaaattctcaagtggttgcgggaaatattgatctgcaggaataaatttcttcttaaaaataagcaggcagatagaagttcctgtcactttctccttttttacggggtaggatgtgatattccttctagtggaaataccagtcaaatgtccatggatcatgaagaattactacgtactcctggagcctctctccggaagggaaaagggaactcctctatggatagtgcagcaggatgcagcggaacccccccgatttgccgacaagcccagaccaaactagaagtggccctgtacatgtttctgtggaaccctgacactgaagctgttctggttgccatgtcctgtttccgccacctctgtgaggaagcagatatccggtgtggggtggatgaagtgtcagtgcataacctcttgcccaactataacacattcatggagtttgcctctgtcagcaatatgatgtcaacaggaagagcagcacttcagaaaagagtgatggcactgctgaggcgcattgagcatcccactgcaggaaacactgaggcttgggaagatacacatgcaaaatgggaacaagcaacaaagctaatccttaactatccaaaagccaaaatggaagatggccaggctgctgaaagccttcacaagaccattgttaagaggcgaatgtcccatgtgagtggaggaggatccatagatttgtctgacacagactccctacaggaatggatcaacatgactggcttcctttgtgcccttgggggagtgtgcctccagcagagaagcaattctggcctggcaacctatagcccacccatgggtccagtcagtgaacgtaagggttctatgatttcagtgatgtcttcagagggaaacgcagatacacctgtcagcaaatttatggatcggctgttgtccttaatggtgtgtaaccatgagaaagtgggacttcaaatacggaccaatgttaaggatctggtgggtctagaattgagtcctgctctgtatccaatgctatttaacaaattgaagaataccatcagcaagttttttgactcccaaggacaggttttattgactgataccaatactcaatttgtagaacaaaccatagctataatgaagaacttgctagataatcatactgaaggcagctctgaacatctagggcaagctagcattgaaacaatgatgttaaatctggcaggtatgttcgtgtgcttgggaatatggtccatgcaattcaaataaaaacgaaactgtgtcaattagttgaagtaatgatggcaaggagagatgacctctcattttgccaagagatgaaatttaggaataagatggtagaatacctgacagactgggttatgggaacatcaaaccaagcagcagatgatgatgtaaaatgtcttacaagagatttggaccaggcaagcatggaagcagtagtttcacttctagctggtctccctctgcagcctgaagaaggagatggtgtggaattgatggaagccaaatcacagttatttcttaaatacttcacattatttatgaaccttttgaatgactgcagtgaagttgaagatgaaagtgcgcaaacaggtggcaggaaacgtggcatgtctcggaggctggcatcactgaggcactgtacggtccttgcaatgtcaaacttactcaatgccaacgtagacagtggtctcatgcactccataggcttaggttaccacaaggatctccagacaagagctacatttatggaagttctgacaaaaatccttcaacaaggcacagaatttgacacacttgcagaaacagtattggctgatcggtttgagagattggtggaactggtcacaatgatgggtgatcaaggagaactccctatagcgatggctctggccaatgtggttccttgttctcagtgggatgaactagctcgagttctggttactctgtttgattctcggcatttactctaccaactgctctggaacatgttttctaaagaagtagaattggcagactccatgcagactctcttccgaggcaacagcttggccagtaaaataatgacattctgtttcaaggtatatggtgctacctatctacaaaaactcctggatcctttattacgaattgtgatcacatcctctgattggcaacatgttagctttgaagtggatcctaccaggttagaaccatcagagagccttgaggaaaaccagcggaacctccttcagatgactgaaaagttcttccatgccatcatcagttcctcctcagaattcccccctcaacttcgaagtgtgtgccactgtttataccaggtggttagccagcgtttccctcagaacagcatcggtgcagtaggaagtgccatgttcctcagatttatcaatcctgccattgtctcaccgtatgaagcagggattttagataaaaagccaccacctagaatcgaaaggggcttgaagttaatgtcaaagatacttcagagtattgccaatcatgttctcttcacaaaagaagaacatatgcggcctttcaatgattttgtgaaaagcaactttgatgcagcacgcaggtttttccttgatatagcatctgattgtcctacaagtgatgcagtaaatcatagtctttccttcataagtgacggcaatgtgcttgctttacatcgtctactctggaacaatcaggagaaaattgggcagtatctttccagcaacagggatcataaagctgttggaagacgaccttttgataagatggcaacacttcttgcatacctgggtcctccagagcacaaacctgtggcagatacacactggtccagccttaaccttaccagttcaaagtttgaggaatttatgactaggcatcaggtacatgaaaaagaagaattcaaggctttgaaaacgttaagtattttctaccaagctgggacttccaaagctgggaatcctattttttattatgttgcacggaggttcaaaactggtcaaatcaatggtgatttgctgatataccatgtcttactgactttaaagccatattatgcaaagccatatgaaattgtagtggaccttacccataccgggcctagcaatcgctttaaaacagactttctctctaagtggtttgttgtttttcctggctttgcttacgacaacgtctccgcagtctatatctataactgtaactcctgggtcagggagtacaccaagtatcatgagcggctgctgactggcctcaaaggtagcaaaaggcttgttttcatagactgtcctgggaaactggctgagcacatagagcatgaacaacagaaactacctgctgccaccttggctttagaagaggacctgaaggtattccacaatgctctcaagctagctcacaaagacaccaaagtttctattaaagttggttctactgctgtccaagtaacttcagcagagcgaacaaaagtcctagggcaatcagtctttctaaatgacatttattatgcttcggaaattgaagaaatctgcctagtagatgagaaccagttcaccttaaccattgcaaaccagggcacgccgctcaccttcatgcaccaggagtgtgaagccattgtccagtctatcattcatatccggacccgctgggaactgtcacagcccgactctatcccccaacacaccaagattcggccaaaagatgtccctgggacactgctcaatatcgcattacttaatttaggcagttctgacccgagtttacggtcagctgcctataatcttctgtgtgccttaacttgtacctttaatttaaaaatcgagggccagttactagagacatcaggtttatgtatccctgccaacaacaccctctttattgtctctattagtaagacactggcagccaatgagccacacctcacgttagaatttttggaagagtgtatttctggatttagcaaatctagtattgaattgaaacacctttgtttggaatacatgactccatggctgtcaaatctagttcgtttttgcaagcataatgatgatgccaaacgacaaagagttactgctattcttgacaagctgataacaatgaccatcaatgaaaaacagatgtacccatctattcaagcaaaaatatggggaagccttgggcagattacagatctgcttgatgttgtactagacagtttcatcaaaaccagtgcaacaggtggcttgggatcaataaaagctgaggtgatggcagatactgctgtagctttggcttctggaaatgtgaaattggtttcaagcaaggttattggaaggatgtgcaaaataattgacaagacatgcttatctccaactcctactttagaacaacatcttatgtgggatgatattgctattttagcacgctacatgctgatgctgtccttcaacaattcccttgatgtggcagctcatcttccctacctcttccacgttgttactttcttagtagccacaggtccgctctcccttagagcttccacacatggactggtcattaatatcattcactctctgtgtacttgttcacagcttcattttagtgaagagaccaagcaagttttgagactcagtctgacagagttctcattacccaaattttacttgctgtttggcattagcaaagtcaagtcagctgctgtcattgccttccgttccagttaccgggacaggtcattctctcctggctcctatgagagagagacttttgctttgacatccttggaaacagtcacagaagctttgttggagatcatggaggcatgcatgagagatattccaacgtgcaagtggctggaccagtggacagaactagctcaaagatttgcattccaatataatccatccctgcaaccaagagctcttgttgtctttgggtgtattagcaaacgagtgtctcatgggcagataaagcagataatccgtattcttagcaaggcacttgagagttgcttaaaaggacctgacacttacaacagtcaagttctgatagaagctacagtaatagcactaaccaaattacagccacttcttaataaggactcgcctctgcacaaagccctcttttgggtagctgtggctgtgctgcagcttgatgaggtcaacttgtattcagcaggtaccgcacttcttgaacaaaacctgcatactttagatagtctccgtatattcaatgacaagagtccagaggaagtatttatggcaatccggaatcctctggagtggcactgcaagcaaatggatcattttgttggactcaatttcaactctaactttaactttgcattggttggacaccttttaaaagggtacaggcatccttcacctgctattgttgcaagaacagtcagaattttacatacactactaactctggttaacaaacacagaaattgtgacaaatttgaagtgaatacacagagcgtggcctacttagcagctttacttacagtgtctgaagaagttcgaagtcgctgcagcctaaaacatagaaagtcacttcttcttactgatatttcaatggaaaatgttcctatggatacatatcccattcatcatggtgacccttcctataggacactaaaggagactcagccatggtcctctcccaaaggttctgaaggataccttgcagccacctatccaactgtcggccagaccagtccccgagccaggaaatccatgagcctggacatggggcaaccttctcaggccaacactaagaagttgcttggaacaaggaaaagttttgatcacttgatatcagacacaaaggctcctaaaaggcaagaaatggaatcagggatcacaacaccccccaaaatgaggagagtagcagaaactgattatgaaatggaaactcagaggatttcctcatcacaacagcacccacatttacgtaaagtttcagtgtctgaatcaaatgttctcttggatgaagaagtacttactgatccgaagatccaggcgctgcttcttactgttctagctacactggtaaaatataccacagatgagtttgatcaacgaattctttatgaatacttagcagaggccagtgttgtgtttcccaaagtctttcctgttgtgcataatttgttggactctaagatcaacaccctgttatcattgtgccaagatccaaatttgttaaatccaatccatggaattgtgcagagtgtggtgtaccatgaagaatccccaccacaataccaaacatcttacctgcaaagttttggttttaatggcttgtggcggtttgcaggaccgttttcaaagcaaacacaaattccagactatgctgagcttattgttaagtttcttgatgccttgattgacacgtacctgcctggaattgatgaagaaaccagtgaagaatccctcctgactcccacatctccttaccctcctgcactgcagagccagcttagtatcactgccaaccttaacctttctaattccatgacctcacttgcaacttcccagcattccccaggaatcgacaaggagaacgttgaactctcccctaccactggccactgtaacagtggacgaactcgccacggatccgcaagccaagtgcagaagcaaagaagcgctggcagtttcaaacgtaatagcattaagaagatcgtgtgaagcttgcttgctttcttttttaaaatcaacttaacatgggctcttcactagtgaccccttccctgtccttgccctttccccccatgttgtaatgctgcacttcctgttttataatgaacccatccggtttgccatgttgccagatgatcaactcttcgaagccttgcctaaatttaatgctgccttttctttaactttttttcttctacttttggcgtgtatctggtatatgtaagtgttcagaacaactgcaaagaaagtgggaggtcaggaaacttttaactgagaaatctcaattgtaagagaggatgaattcttgaatactgctactactggccagtgatgaaagccatttgcacagagctctgccttctgtggttttcccttcttcatcctacagagtaaagtgttagtcctatttatacatttttcaagatacaagtttatgagagaaatagtattataaccccagtatgtttaatcttttagctgtggactttttttttaaccgtacaaaactgaaagaaccatagaggtcaagcctcagtgacttgacaccataaagccacagacaaggtacttgggggggagggcagggaaatttcatattttatagtggattcttaagaaatactaacacttgagtattagcaataattacaggaaaataagtgcgaccacatatatcttaacattactgaattaaaactatggcttctaagtccttatccaaactcagtcatccaaactagtttatttttttctccagttgattatcttttaatttttaattttgctaaaggtggtttttttgtgttttgttttttgtaaaccaaaactatactaagtatagtaattatatatatatatatattttttcccctccccctcttctttcctaactaattctgagcagggtaatcagtgaacaaagtgttgaaaattgttcccagaaggtaattttcatagatgtttgcattagctccatagcaaaatggaatggtacgtgacatttagggtagctgatatttttattttgttaaataatttccaagaatagagtatggtgtatattataaatttctttgataagatgtattttgaatgtcttttaatcttcctcctcctctccaaaaaaatcagaaacctctttaagaaaacatgtaggttatatatgctagaattgcatttaatcactgtgaaaagactggtcagcctgcattagtatgacagtaggggggctgttagaattgctgctatactggtggtatggattatcatggcattggaattttcatagtaatgcagatccaatttctttgtggtacctgcagtttacaaaataatttgacttcagtgagcatattggtatctggatgttccaatttagaactaaaccatatttattacaaaaagatattaatccctctactcccaggttccctttatatgttaagatataatggctttgaggggggaaaaaataaacctaggggagaggggagtttcctgtagtgctgtttcattagaggatttcagtaaattaaattccacagctaattcaataaataatggtacatttaagtgttctgattttaataatatatttcacatttatccacacagtaacaatgtaatatgttaatgtaaataaaattggttttgatactcagaaataacaagaatttaattttttaaatttgtttacagtcctgggaaaagtaagaattatttgccaaaataagaggaaagaaaaccttagtattattaatgagtttaccatagaattgttggaaatactgaagacaggtgcaatttactaaacttttgtttttaaactattgtagaggctgcattagaagaaaatgtttataatgacagagcaactatgactatataaaaaagctgaaattagaactgtgtttagaaatagatcagtaacccagtgccaaggatgccaagctgccaccatggtcttggctctcccacaacccagtgtttctggggtaagtttcacagtttctaggccctggaatagcaggcagtgtaagcctttgataactttagttcgatgtttttcttgtttttgtttgttggtttggtgcatatgatagtgggtgttatgctattttgctcttcccatcaaaataaagaaacttccagaggtttactgttaaaaatactgatatttccataaacgggtttaccaagggtgtagtatttcataccgcctgaaatgatcagcattggcacaaatcaaaattcagccgcctttgaaatgcaaaaatacctttgactagtaagtacatcctaggagtttgaaaacttaactaaggtttaaaatttaccttgtttaaagaacttctgacttttgaggaaaatctagctttccaagtaactaaaatgtacatgagataaacctctcaccactatgtgtcccttgagaaatgcaacacttttttagtcttcatacttgtaatctataaaagaaattctgaagtttagaccaagttgcccatttctgcgtaattgacataagttctgttaaaaatattataagtaattcgtttcggtttgtagatgtttcccctgacttgttaaagaggaaaccaggaactcagtcatgtttttgtcctggataatctacctgttatgccagtactcccatccgaggggcatgcccttagttgcccagatggagatgcagttcagtagatttggggcaaagtggctacagctctgtcttccattcactcaacacctgttcatgactgagccaggtgcccaggacacatcctaaacagtcagcttctatcctgtgtcctagttggggagacagagtgccagccagcaaccctcccaggtttgtaggttttaggggttttcagttttgtttgggttttttgttttttgtttttgtttctacatccttccccgactcccaggcataatgaggcatgtcttactcaatgttatgcaatggatttaggcaaaaattcattcttagtgtcagccacacaattttttttaatgcagtatattcacctgtaaatagtttgtgtaaaatttgacaaaaaaagtatatttactatactgtaaatatatgtgatgatatattgtattattttgcttttttgtaaagcagttagttgctgcacatggataacaacaaaaatttgattattctcgtgttagtattgttaacttctttttgcgactgcgttacatcatttaaagaaaatgctgtgtattgtaaacttaaattgtatatgataacttactgtcctttccatccgggcctaaactttggcagttcctttgtctacaaccttgttaatactgtaaacagttgtacgccagcaggaaaaatactgcccaacagacaaaatcgatcattgtaggggaaaatcatagaaatccatttcagatctttattgttcctcaccccattttcctccttgtgtatgtacttcccccacccccctttttttaagtaaaatgtaaattcaatctgctctaagaaaaaaaaaaaaaaaaaaaa

SEQ ID NO: 269 - protein, 543 aa, Homo sapiens
MAAAKAEMQLMSPLQISDPFGSFPHSPTMDNYPKLEEMMLLSNGAPQFLGAAGAPEGSGSNSSSSSSGGGGGGGGGSNSSSSSSTFNPQADTGEQPYEHLTAESFPDISLNNEKVLVETSYPSQTTRLPPITYTGRFSLEPAPNSGNTLWPEPLFSLVSGLVSMTNPPASSSSAPSPAASSASASQSPPLSCAVPSNDSSPIYSAAPTFPTPNTDIFPEPQSQAFPGSAGTALQYPPPAYPAAKGGFQVPMIPDYLFPQQQGDLGLGTPDQKPFQGLESRTQQPSLTPLSTIKAFATQSGSQDLKALNTSYQSQLIKPSRMRKYPNRPSKTPPHERPYACPVESCDRRFSRSDELTRHIRIHTGQKPFQCRICMRNFSRSDHLTTHIRTHTGEKPFACDICGRKFARSDERKRHTKIHLRQKDKKADKSVVASSATSSLSSYPSPVATSYPSPVTTSYPSPATTSYPSPVPTSFSSPGSSTYPSPVHSGFPSPSVATTYSSVPPAFPAQVSSFPSSAVTNSFSASTGLSDMTATFSPRTIEIC

SEQ ID NO: 270 - DNA, 3137 bp, Homo sapiens
gagagatcccagcgcgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaactgtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaaaaaaaaagaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttctttttttttttttttgaaagtgttttttcttcgtccttttggtttaaaaagtttcacgtcttggtgccttttgtgtgatgcgccttgctgatggcttgacatgtgcaattgtgagggacatgctcacctctagccttaaggggggcagggagtgatgatttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggaatgttgtagttacctactgagtaggcggcgatttttgtatgttatgaacatgcagttcattattttgtggttctattttactttgtacttgtgtttgcttaaacaaagtgactgtttggcttataaacacattgaatgcgctttattgcccatgggatatgtggtgtatatccttccaaaaaattaaaacgaaaataaagta

SEQ ID NO: 271 - protein, 476 aa, Homo sapiens
MMTAKAVDKIPVTLSGFVHQLSDNIYPVEDLAATSVTIFPNAELGGPFDQMNGVAGDGMINIDMTGEKRSLDLPYPSSFAPVSAPRNQTFTYMGKFSIDPQYPGASCYPEGIINIVSAGILQGVTSPASTTASSSVTSASPNPLATGPLGVCTMSQTQPDLDHLYSPPPPPPPYSGCAGDLYQDPSAFLSAATTSTSSSLAYPPPPSYPSPKPATDPGLFPMIPDYPGFFPSQCQRDLHGTAGPDRKPFPCPLDTLRVPPPLTPLSTIRNFTLGGPSAGVTGPGASGGSEGPRLPGSSSAAAAAAAAAAYNPHHLPLRPILRPRKYPNRPSKTPVHERPYPCPAEGCDRRFSRSDELTRHIRIHTGHKPFQCRICMRNFSRSDHLTTHIRTHTGEKPFACDYCGRKFARSDERKRHTKIHLRQKERKSSAPSASVPAPSTASCSGGVQPGGTLCSSNSSSLGGGPLAPCSSRTRTP

SEQ ID NO: 272 - DNA, 2979 bp, Homo sapiens
aactgagcgaggagcaattgattaatagctcggcgaggggactcactgactgttataataacactacaccagcaactcctggcttcccagcagccggaacacagacaggagagagtcagtggcaaatagacatttttcttatttcttaaaaaacagcaacttgtttgctacttttatttctgttgatttttttttcttggtgtgtgtggtggttgtttttaagtgtggagggcaaaaggagataccatcccaggctcagtccaacccctctccaaaacggcttttctgacactccaggtagcgagggagttgggtctccaggttgtgcgaggagcaaatgatgaccgccaaggccgtagacaaaatcccagtaactctcagtggttttgtgcaccagctgtctgacaacatctacccggtggaggacctcgccgccacgtcggtgaccatctttcccaatgccgaactgggaggcccctttgaccagatgaacggagtggccggagatggcatgatcaacattgacatgactggagagaagaggtcgttggatctcccatatcccagcagctttgctcccgtctctgcacctagaaaccagaccttcacttacatgggcaagttctccattgaccctcagtaccctggtgccagctgctacccagaaggcataatcaatattgtgagtgcaggcatcttgcaaggggtcacttccccagcttcaaccacagcctcatccagcgtcacctctgcctcccccaacccactggccacaggacccctgggtgtgtgcaccatgtcccagacccagcctgacctggaccacctgtactctccgccaccgcctcctcctccttattctggctgtgcaggagacctctaccaggacccttctgcgttcctgtcagcagccaccacctccacctcttcctctctggcctacccaccacctccttcctatccatcccccaagccagccacggacccaggtctcttcccaatgatcccagactatcctggattctttccatctcagtgccagagagacctacatggtacagctggcccagaccgtaagccctttccctgcccactggacaccctgcgggtgccccctccactcactccactctctacaatccgtaactttaccctggggggccccagtgctggggtgaccggaccaggggccagtggaggcagcgagggaccccggctgcctggtagcagctcagcagcagcagcagccgccgccgccgccgcctataacccacaccacctgccactgcggcccattctgaggcctcgcaagtaccccaacagacccagcaagacgccggtgcacgagaggccctacccgtgcccagcagaaggctgcgaccggcggttctcccgctctgacgagctgacacggcacatccgaatccacactgggcataagcccttccagtgtcggatctgcatgcgcaacttcagccgcagtgaccacctcaccacccatatccgcacccacaccggtgagaagcccttcgcctgtgactactgtggccgaaagtttgcccggagtgatgagaggaagcgccacaccaagatccacctgagacagaaagagcggaaaagcagtgccccctctgcatcggtgccagccccctctacagcctcctgctctgggggcgtgcagcctgggggtaccctgtgcagcagtaacagcagcagtcttggcggagggccgctcgccccttgctcctctcggacccggacaccttgagatgagactcaggctgatacaccagctcccaaaggtcccggaggccctttgtccactggagctgcacaacaaacactaccaccctttcctgtccctctctccctttgttgggcaaagggctttggtggagctagcactgccccctttccacctagaagcaggttcttcctaaaacttagcccattctagtctctcttaggtgagttgactatcaacccaaggcaaaggggaggctcagaaggaggtggtgtggggacccctggccaagagggctgaggtctgaccctgctttaaagggttgtttgactaggttttgctaccccacttccccttattttgacccatcacaggtttttgaccctggatgtcagagttgatctaagacgttttctacaataggttgggagatgctgatcccttcaagtggggacagcaaaaagacaagcaaaactgatgtgcactttatggcttgggactgatttgggggacattgtacagtgagtgaagtatagcctttatgccacactctgtggccctaaaatggtgaatcagagcatatctagttgtctcaacccttgaagcaatatgtattataaactcagagaacagaagtgcaatgtgatgggaggaacatagcaatatctgctccttttcgagttgtttgagaaatgtaggctattttttcagtgtatatccactcagattttgtgtatttttgatgtacactgttctctaaattctgaatctttgggaaaaaatgtaaagcatttatgatctcagaggttaacttatttaagggggatgtacatatattctctgaaactaggatgcatgcaattgtgttggaagtgtccttggtgccttgtgtgatgtagacaatgttacaaggtctgcatgtaaatgggttgccttattatggagaaaaaaaatcactccctgagtttagtatggctgtatatttctgcctattaatatttggaattttttttagaaagtatatttttgtatgctttgttttgtgacttaaaagtgttacctttgtagtcaaatttcagataagaatgtacataatgttaccggagctgatttgtttggtcattagctcttaatagttgtgaaaaaataaatctattctaacgcaaaaccactaactgaagttcagataatggatggtttgtgactatagtgtaaataaatacttttcaacaata

SEQ ID NO: 273 - protein, 713 aa, Homo sapiens
MGPPSPGDDEEEAAAAAGAPAAAGATGDLASAQLGGAPNRWEVLSATPTTIKDEAGNLVQIPSAATSSGQYVLPLQNLQNQQIFSVAPGSDSSNGTVSSVQYQVIPQIQSADGQQVQIGFTGSSDNGGINQESSQIQIIPGSNQTLLASGTPSANIQNLIPQTGQVQVQGVAIGGSSFPGQTQVVANVPLGLPGNITFVPINSVDLDSLGLSGSSQTMTAGINADGHLINTGQAMDSSDNSERTGERVSPDINETNTDTDLFVPTSSSSQLPVTIDSTGILQQNTNSLTTSSGQVHSSDLQGNYIQSPVSEETQAQNIQVSTAQPVVQHLQLQESQQPTSQAQIVQGITPQTIHGVQASGQNISQQALQNLQLQLNPGTFLIQAQTVTPSGQVTWQTFQVQGVQNLQNLQIQNTAAQQITLTPVQTLTLGQVAAGGAFTSTPVSLSTGQLPNLQTVTVNSIDSAGIQLHPGENADSPADIRIKEEEPDPEEWQLSGDSTLNTNDLTHLRVQVVDEEGDQQHQEGKRLRRVACTCPNCKEGGGRGTNLGKKKQHICHIPGCGKVYGKTSHLRAHLRWHSGERPFVCNWMYCGKRFTRSDELQRHRRTHTGEKKFVCPECSKRFMRSDHLAKHIKTHQNKKGIHSSSTVLASVEAARDDTLITAGGTTLILANIQQGSVSGIGTVNTSATSNQDILTNTEIPLQLVTVSGNETME

SEQ ID NO: 274 - DNA, 11352 bp, Homo sapiens
actcagccgtcaccgctcgctctgctggccgctacctgcagcaagatagggccgccatcgccgggcgacgacgaggaggaggcggccgccgcagccggggcccccgccgccgccggagcgacaggtgatttggcttctgcacagttaggaggagcaccaaaccgatgggaggttttgtcagccacacctacaactataaaagatgaagctggtaatctagtccagattccaagtgctgctacttcaagtgggcagtatgttcttccccttcagaatttgcagaatcaacaaatattttccgttgcaccaggatcagattcatcaaatggtacagtgtccagtgttcaattcaagtgataccacagatccagtcagcagatggtcagcaggttcaaattggtttcacaggctcttcagataatgggggtataaatcaagaaagcagtcaaattcagatcattcctggctctaatcaaaccttacttgcctctggaacaccttctgctaacatccagaatctcataccacagactggtcaagtccaggttcagggagttgcaattggtggttcatcttttcctggtcaaacccaagtagttgctaatgtgcctcttggtctgccaggaaatattacgtttgtaccaatcaatagtgtcgatctagattctttgggactctcgggcagttctcagacaatgactgcaggcattaatgccgacggacatttgataaacacaggacaagctatggatagttcagacaattcagaaaggactggtgagcgggtttctcctgatattaatgaaactaatactgatacagatttatttgtgccaacatcctcttcatcacagttgcctgttacgatagatagtacaggtatattacaacaaaacacaaatagcttgactacatctagtgggcaggttcattcttcagatcttcagggaaattatatccagtcgcctgtttctgaagagacacaggcacagaatattcaggtttctacagcacagcctgttgtacagcatctacaacttcaagagtctcagcagccaaccagtcaagcccaaattgtgcaaggtattacaccacagacaatccatggtgtgcaagccagtggtcaaaatatatcacaacaggctttgcaaaatcttcagttgcagctgaatcctggaacctttttaattcaggcacagacagtgaccccttctggacaggtaacttggcaaacgtttcaagtacaaggggtccagaacttgcagaatttgcaaatacagaatactgctgcccaacaaataactttgacgcctgttcaaaccctcacacttggtcaagttgcggcaggtggagccttcacttcaactccagttagtctaagcactggtcagttgccaaatctacaaacagttacagtgaactctatagattctgctggtatacagctacatccaggagagaatgctgacagtcctgcagatattaggatcaaggaagaagaacctgatcctgaagagtggcagctcagtggtgattctaccttgaataccaatgacctaacacacttaagagtacaggtggtagatgaagaaggggaccaacaacatcaagaaggaaaaagacttcggagggtagcttgcacctgtcccaactgtaaagaaggtggtggaagaggtaccaatcttgggaaaaagaagcaacacatttgtcatataccaggatgtggtaaagtctatgggaagacctcacatctgagagctcatctgcgttggcattctggagaacgcccttttgtttgtaactggatgtactgtggtaaaagatttactcgaagtgatgaattacagaggcacagaagaacacatacaggtgagaagaaatttgtttgtccagaatgttcaaaacgctttatgagaagtgaccaccttgccaaacatattaaaacacaccagaataaaaaaggtattcactctagcagtacagtgctggcatctgtggaagctgcgcgagatgatactttgattactgcaggaggaacaacgcttatccttgcaaatattcaacaaggttctgtttcagggataggaactgttaatacttccgccaccagcaatcaagatatccttaccaacactgaaatacctttacagcttgtcacagtttctggaaatgagacaatggagtaaatattacacaaatacttattcattgtggttatttttatacagtagtgagaagaatattgttcctaagttcttagatatctttttattgatgtgcaaaaatttttggattgacagtaacttggttatacatgacactgaaatgccttactttgtatgatattccatagtatattaaaaatggtaaaattgcatgggttttgtaggtacttttggaatctagaagaaatgaaattttaccaagttatataaagagaaaattgaatttaacaatgcgaatggtagtctaaccaaatgcatcaatcctgtgtggtttagtgtaaaaatgagaacatgttggtatttatctattgtaagataaaaaagctggtgggtgaaagaaatcatgttatgataaaaaattttgtaattttcttgatgactggaatttttattatgcataactgacaaatcaagtttccaagcaaatgttacatagtgtaggctttacttagcttatcaatttgtcattttgaagctaattattttaattaggttaactatgtacaatattttaagcattactcttgtaagattttgaaaactacattttaacatggaactctagggatagtcaccttttaaatcctgttgaaaagccatgtttaagatttaatttgccaaaataatgtcttgttaatattctttcaataacgaagttgggcaatataaccaatgtttaaaaaagtttaaaatgtataagttgaggcatttgggtggtaagagaatgttatagtgaattatcccttttcttgactattggaggaccaaaaaaataaggtgtattgcgtcttagcagtgatttttatccaatcttgtttccaaaaaccatgtctcccagggccttaaaagccatcatgtaaattaccagtaaagtgtaacatatgcaaacataacaaaatcacttccatagtgacgatactccaaccatatggatattagtcatagaagaactagaggttttatgatatttttttaagtcttttttttttttgtctaggtagtcagtctgcacttaaatatcaatcattttccttttttgcttcttcccttaaaatttatatgtatccagtacatttaattgagaagcgtatgttttttattatgctgtattttctttttattttttaattattgtttatattttcaattcaaaaatgtacaaaataaagttacattgctggtcttgtaagagctatacagttttcctaaatgtatacctgtaactgcagcagttcacctatttcaaaaatttggaattctgttcatttgttattcttaagaccacctcaaatttaaaggctaccttattgtacgtttaaagtgtattataacagtgtggtagttaataaaacactatttttttttcttttgagtttgttgtattcctatgcataaaaaatattgcagtggtatggggtaagaattggtggtttatttttcttcaacttggctttttatttttagattcttgattttagacactgaattgtaaacaggcatttatttgaagaagagatatatagagacactggtcatttactaattttttacctagagtaaataagaatgagcttattaaataaaatttttgaaaaaaagtcttagcccttagcccacattgattcatatcagttttatcagtaccattttgcaatttttttgttttccgttttaaagcaatgcagaatattttgatttatcgaaaacctgaatttacattaagactcctgaaaatgataagacaagcgttggtaaccatggcaggagttacttgaaaaagttgcctttgaatttgcatgtgtttcatcattataaaggcagagtaggaggaaagagtattaatgtgattgtgtattgtagatgttttaaagtaaaaatcaagtttcttaacacatgtatacagtgggggtaaagatgtccattttctgttttccaggcccagtctgactctgtctgtaatacctgattgcattggagaactctagacacgcataaacatggacagtttttctaaatgtgagacttaagcctgtgatgtaaaataggaagttctacttggaataatataaaggaaccactagaatttacaattattttgaagttacagggattagattttgaatcttaaaatcctttaggtaatttttagaatttttaaattaagattaatgtgaagagaattaagtgagcagcaggtggttcacttgagcaaactgcccattaagtcagattaaaccatttgaatgatagtagagatgttttaagtaatactggatttttacagtaagtttatggtgtactttgaatcgataggtgtccatgcatattttatgaattcgtggagaatgaatgcaatgaagaaagtaagtagtcttgaaaattatttaaataaagttgtagatttttttagtgccccctaggaatatattagtgaactttggaacttttaccaaagttatgtaacctcagtgtagataattttaaatatttctatttttatattttaaaatgttgaatatactctggaaacaacatttgaagatttgctctgatgtcaactttttctggttataaaacctattagtattgtgtataattctcagggtaggtatactctaataggtgttttgtcaattgctttatttttgtaaaggctagagttagtgcatattgaatatatttatgtacaaataattcctgttgtaacatttagtggacgcgattatctgtatacctcaaattttaatttaagaaagtatcacttaaagagcatctcattttctatagattgaggcttaattactgaaaagtgactcaaccaaaaagcacataaccttttaaaggagctacacctaccgcagaaagtcagatgccctgtaaataactttggtctttcaaaatagtggcaatgcttaagatacttaaaaatacacatacatataagctgaaagcatgtcaagcctatttcatagaaaatagttcttaaacagtattgttcattagaaattgctggggagcattttagagattccataggcctggtagccacctcagcttactaaatcaacatctctggagatggagtgtatatgtgttttgaaacagctgctcaagtggttctgttaaacactcctgcgttacaatcacttaaaatagagcaagcatccccttaggctcttaattgtagtttaaattccagtactgcctactcagacccaaaagttttgttttatgaaaaatttgtattgtgttcaatattgtttgaaatttggggttgttgcataaatgattatggaataacatttggttttaaaataatataaactgacatgttatgctacctgttacacaatttggttttcagttttaattatatgaagctggtaacaatcgtttttgttgtaaaagaattatttttcactaaacagtatgtttaaaactgactgccatgaatgagtactaagtcttttgttgtctgacaataagcacaaaacaaattaattgatatctttggtacaaatttgatatttttgtgaaatcacctcataattttatttagtgttgaagaaacaacattggccccttgccttgttcagacagatttgcgtataatgtaaatatatatattagtggcagaaacaaagtactgtagaaacctagaagagggagaattctgcatgaagtctgggaaactcagcagaaatggcgtttgcaaaggtacagtgtggtatgttgggtgatgggggactttgtgagggacagagtggaaaaatttttaagaggggctgccaaattgcaaaagagaagaattttttttgtcagtgattcctagtctttttggaatcctacaccttctccccagaaaaattcattctagtccagggtttattgtttgttttttccctatatttgacagggtctgtctctgtcacacagtgcagtggtgcaatcatggcttactgcagactccacttactggtctcaagcaatcctccccacttcggcctcttaagtagcttggaccacaggtgcacaccaccatgctcagttaattttaatttgttttgtagagatggggtctcactatattgcctaggctggtcttgaattcctgggctcaagtgatccttccacctctgcctcccaaagtgttgggattataggcgtgagccaccacgcttggccaaatctggagtctaaagggtatacaaggtttttttttttcccatgttggcttttatttgatgttataaagtcttcatgatatgaatatattttttaaaaaggtgtcatgtatattgtcatgtaacatgattcatgccacttcattgtattaaatacgtttaagatacagtttttgatgttaagaatgatatcctgagaaggcctatctccttcagtccttttccccatttttcaccttttaactcttgcttctgaatctatgctaagctacttactagatgtgtgatattggtagttttcttaccttaaaacctcattttcatcatccatgaagaggctaacaatagtactccctgttgataggattgttgtattaaaatataagcattcagcatagtgcctgacttaacggtagagattcaaatggtaacctccttccaatgccttcctccccccttaactctggagattccatttttctgtagtgaagtgttttagaattttcattgtttgactatggttcatacattgatttttccaaaatgagaagaagtcttatttctaatgcaaaaatgtgaaaagaacagttggaacctaaagtgatagtggatgaagtgtctgaagtgactgccctatcagaaaaggatggaataagaagaaaagactgaagcacctaaatgtgtattttcttgaggaaattacacccctgtgtaagagtctatcctatttgaacatttctaaaaaccagccgaagaatcttcaggttcattgcgactgaaagataaagtctagcactgaagtggtttttaagattaggaaaggccatcagagaaatgcagttatttctcccctccatccttcccccacaaaaaaaagtctaagcctccgattaatcgacaacaacgaaatacaggaagtattggcttagtgaccttttaggatatctgtccgacttacatcccttctctgagcattactttctgccaccttccgtgaggagctgttcagaaatcagacaaggagtggacatctggtcaaagttgagccaattagatgatttctcctgagaatttggaattggaaaactgatgtcttgggaggtcacatctggaacatacatgggaggcagagaaagcaaagatgacattcaaccccagaagaaaaagaaaatggctttcttgattcctgataacttggcagtgtttgttccagtgtcttgcatttcactatctgcatttcatcctcctggggttccacaagatagccttaaaaccttacagagagactccccaacttagttttttcttaagtcagaaggctgttacttgctaccaaataatgccaactaagacaactgaggtacagtatattctctcgtaaaacaccatagagttgatgacttgatcctatagaaaagggtccccaacccctgggccacagaccggtactggtccctggtctgtgaggaaccacctgggccacagactggtcctggtccctggtctgtgaggaaccaggccatacagcaggaggtaagcgagcattcctgcctgagctctgcctcctgtcagatgagccacaacattagattctcataggagtgcgaaccccgttgtgaaccccgcatgcgagggatctaggtagtgccctccttaagagaatctaatgtctgatgatctgaggtagagcagtttcatcctacaaccatccccaccccccgacccccatccatgaaaaaattgtcttcctcaaaactagtccctggtgccaaaaagtttggggaccgccgtcctaggaaataccaacaaaaagtcacgtttattgcctgccaagtgagtcaggtttagacaaggcagaacttagtatatagcttggatgaatcagaaagggtgggccttgaaagactggtagaatgtgtccaagaaaactgattaaaagccttagaagtccctctacagtttcaggacgccctcttaacagatggctgtatctttatctgtggttggtcttgtggaatactgactttctgccagcattagcctgtgtttctatgtcacaccaagtcacgtatattttcattgtgtgttaggactcagaataggtttgggtctttcttttaattatgtatacccaattacttagtcctcctcacaccctgatcctttaaaaattcttaagttgtgttaattgcatttttctcaattctactcctagtaactctgtgtgtttttttccatctttattcatttagtaaagttgaaacctttcatagcataatatagtgattaagtgcataggtttgggacttagacacacatgggcttgcttgtctcccagttctgccgcttaccacctatgtgacctttcactctttacctttccactcttagcctgttctctaactataaaatgagaatgatgctagcgtcatcttcatagagtgattatggagataaataagttaatgcatgtaaaccactttccataatgcctggcacatattatattatgtattagtaaatgtaagcactggaagaatcagtagtcttcctacacttgaaaatagttgtcttcaactattgttgtattaatgagttaattcaccttgttaagtcaccttgatccacctaattgtcagccaacatttattaacgaaactgctagtattcgtattgtgccttttttattatgaaacatttcaagaatacagaaaaatgcagaaaacaatgtaacaaatacctaagtatctatcacccaacttttatagtcttatttttacctatatattttttcttttagaaaggaatgatcacagttgtgcctgaaatctgtatagccctgtctcatttcatttgtctccctttacccacataagtaattgcagctctgaatttgatgtttatcagaatgataccatgagtggttttatatccttattatatgtatgcatacctaggattgtttttctgattttgaaacttcatataaatggtatcattctgtacaaaaccttctgggacttgttttaccactcatgtttttgagatgtatccacactaccatctttctctaaatcattcatttaaatgctgtagttcattgaataagtttatcacaatgtatccattttcttcttgatgagcatctcagttatttccaatttttgacttataaacaatgctgcaatgaaataattgacatatttccttgtgtacatgtgagcatttcttgagatatgtatctagaacttgaatcactggccaacaggatattcttaatcttcagtttcaccagatacttccaaattgatctccataacatgcataccaaattatattcctaccagccatttataggagttcacattttttccataccctcccaatcctgccttggcagatatgttttttccaatgaataacaatgaaattttgttttgggatttgacaaaatgattctagattcatctggaagaaaagcaagtataagtaagaaatttaaaagggacctgaaaaactaagcaatggatatatttaaaaattggtaccagtagggataaccaaatatttgttaactgtagcagaaacaatgcatgtttttctcactggttccaccttctatctctcagtcaagccctgcccaggtgtggtagtcctcatagtctctcactgtaggggtcttctcacatagtagaccactctcttgagttgaatattgaaaagaaggcttggccgggggcagtggctcatgcctgtggtcccagcactttgggaagctgagtcgagcggattgcttgaggtcagcagttcgagagcagcctgactaacatggtgatgaaaagtacaaaattagctgggggtggtggcgcatgcctgcaatcccagctactcgggaggctgaggcacgagaatcgcttgaacgcaggaggcataggttgcagtgagccgagattgcaccactgcactccagcctgggcgacagagcaagatttcgtctcaaaaaaaaaaaaaaaaaaaaaaaaggcttaagtccaactaactgtttccctgctgttcattttatccaacggctggggatataggctactgcacatgatgggttgatggatgtgaaatgataactcatgactttaattctaatttttctatattctggtgaggttgagcatatttttacaagttcataatccattttcctctgatgggagttgcctgtttgaatcctttgcccacttgctttttggggttatttgcaattttttgcattgatcttcaaacattcttaattaatcccaggtacatattattttatatataagatatattttagagatatataggctgatagtatcttttctcagtctaaggcttatcttttaattttgtttatggtgttttgtgtgtgttgttttgcagaagttttattgtatctgaattgtggcttttgtgtcttaagaaattctttacctactgtcataaaaatttttgtctaaaaattttatgattttgcctttctatttatcttgttaattcactttgaaattacttttgtttatggcataaagtccattattttccatatggataatcagttgtcttagcagtttattgaatggtccaacgtttccctgctgattataatgccctctctgttatttatcctaaattcttgacatccggtaaggaagtctcctctgcccacccttctctgtatttcaaaatggttttgactgttcttgaccccttgctctttctgtgaactttaggattaaatgattatgtagaattaaacaatcgggttaaggttttttattagaattacattgaatctatagattaatttggggaaagaatgttatctttctatccatgataattctgtatctctccattaattcaagtctttaatggtttttaaaaataaattattgtctctttgaaaa

SEQ ID NO: 275 - protein, 284 aa, Homo sapiens
MSMLPSFGFTQEQVACVCEVLQQGGNLERLGRFLWSLPACDHLHKNESVLKAKAVVAFHRGNFRELYKILESHQFSPHNHPKLQQLWLKAHYVEAEKLRGRPLGAVGKYRVRRKFPLPRTIWDGEETSYCFKEKSRGVLREWYAHNPYPSPREKRELAEATGLTTTQVSNWFKNRRQRDRAAEAKERENTENNNSSSNKQNQLSPLEGGKPLMSSSEEEFSPPQSPDQNSVLLLQGNMGHARSSNYSLPGLTASQPSHGLQTHQHQLQDSLLGPLTSSLVDLGS

SEQ ID NO: 276 - DNA, 4005 bp, Homo sapiens
aagttccccggcaactagcagcatccaccgggcgggaggtcggaggcagcaaggccttaaaggctactgagtgcgccggccgttccgtgtccagaacctcccctactcctccgccttctcttccttggccgcccaccgccaagttccgactccggttttcgcctttgcaaagcctaaggaggaggttaggaacagccgcgcccccctccctgcggccgccgccccctgcctctcggctctgctccctgccgcgtgcgcctgggccgtgcgccccggcaggccccagccatgtcgatgctgccgtcgtttggctttacgcaggagcaagtggcgtgcgtgtgcgaggttctgcagcaaggcggaaacctggagcgcctgggcaggttcctgtggtcactgcccgcctgcgaccacctgcacaagaacgagagcgtactcaaggccaaggcggtggtcgccttccaccgcggcaacttccgtgagctctacaagatcctggagagccaccagttctcgcctcacaaccaccccaaactgcagcaactgtggctgaaggcgcattacgtggaggccgagaagctgcgcggccgacccctgggcgccgtgggcaaatatcgggtgcgccgaaaatttccactgccgcgcaccatctgggacggcgaggagaccagctactgcttcaaggagaagtcgaggggtgtcctgcgggagtggtacgcgcacaatccctacccatcgccgcgtgagaagcgggagctggccgaggccaccggcctcaccaccacccaggtcagcaactggtttaagaaccggaggcaaagagaccgggccgcggaggccaaggaaagggagaacaccgaaaacaataactcctcctccaacaagcagaaccaactctctcctctggaagggggcaagccgctcatgtccagctcagaagaggaattctcacctccccaaagtccagaccagaactcggtccttctgctgcagggcaatatgggccacgccaggagctcaaactattctctcccgggcttaacagcctcgcagcccagtcacggcctgcagacccaccagcatcagctccaagactctctgctcggccccctcacctccagtctggtggacttggggtcctaagtggggagggactggggcctcgaagggattcctggagcagcaaccactgcagcgactagggacacttgtaaatagaaatcaggaacatttttgcagcttgtttctggagttgtttgcgcataaaggaatggtggactttcacaaatatctttttaaaaatcaaaaccaacagcgatctcaagcttaatctcctcttctctccaactctttccacttttgcattttccttcccaatgcagagatcagggaaaaaaaaaaaaaaaaacccaaacaaacaaaagcacccaggcacccagtctgagttctgggcaactgatacgcctgtttcagcagcctttcttttttttcaatgaatgggaattgcaaatcaactggattttcattatttccttttaatttatatatggagaaatgtgaagagggaaaggaaatggaaagagaaagagaaagggagataaaaatagtgaaaataagagcctccaggctcagaagaactgattacattcttaaggtgaacaggaaaaatacaatctataactttctttgatgaggaaaaattaagtttacatttttcatatttagtgttaaacaatttaatgtagattaaaataaaagaccagtattaggaggaaaaaacaagtgcctaaatgtcttaatgctctctatgtgagacagaaatagacgtgaccattagtaatgcaactatttttgtcaaatttagtgggattttttggttgttgtttgttttcttgggttttttttttttaaatgacaaactctaaaaatgtaccaatgtgaaaaaacactttcctgaatgccattactcatgccctcaaagctttcatatctgtagcctactcctgtaaagggtttctcctgtttctagtttctagtttgcaaaggtatgccaacgaatctggcaacctggtatttgttactaaaacagcatgtgttttcaggtttcttttctattgtacctaaagcagtctaaattaaaacttagtagaacaccaggagtatgattctgtttctgaaaggtgagtggtgtattgctgtcattgggccctatttttttttttaaatatatttttctttcttacttaatggtggctgtgaattgcagggtactttgaaggccatcatctgaaccaagagtagtaactagattaattatatgacagaaagagtgaatttagccttggggtatttattaacttctattatttagatatgcaattttgtttaccactatctcttcacagcattcatatgttaactaagctcttttgtgttaacaagtttatgacaagactgtgaaagtaaaaataatttatctgcttgaagacaaaaaagggaaggagaacaaggatagaaacattgtgaattaatttgtacaaatagaaagcagaccagcaggacaggagctcttttgcagtgctgccggatggtgtctagaaaaatcccagtaatcatgtaggctccatattatttttgcctggggcaaaatgatgtatcttctgtatttagcttttaaaattagtgaaacaaatggcattatttattaaaattctactcaggataacaggattggcttgcttgtgctttgtaaaatattgttccccagggagaatctatttattttctgacatgacagtttcataattttgattttttcccatctataattgtcaccattaatatattatttctttcttactctttcctatttctgttctggtctagaaaactgaggtgtgcttggggaaatcaaggccttattttttaaaactgtcaaatagctttgagttccagggagaaatggtcactgtacttaactgtacacacttttacttataaagtcgtttttccccctcagtgatggacagatgtgcacacagccactcagagaccatcatttggtttgggagctcagggtcccaatctcccttgttagtgttttggatcattaagtcggtgtttatttaagtcactagggtgtttattctccctgtcttgggccacggagaaatgccaccctctgcaggaggggctctcacagggaatctcctcacattcttcacattcactccccaaaacaaacaccctgcacaaagatagctttcaatgaccctgacaggcttcaaaggacgctgcggaaatctctctggaaaataggaagggccaattactttaatttcttacatgccgtctcttcctactccggtgactaccctccactctcccagctccgcctgggataattttaggctcgtggaagttgtgtctcgcagggcgccccggcccacttcctgctcccttagttggtgaatcttggaaatgtctgcagatccggcgaggagcaagagcgctggtcctgtaaaagcccccgtgattactgcttgtaaacttgttaaaaggacaattttctgtcacagtcataaactctttgtaaaacccctggcactaaatccagagcgcgcatattccagatgtgtttaataagaaattgcacaatgtgcctccttccgccatcctcggctcagtctgggtaaaaggggcgagcaggaggaggcgagaaagctggatattgctttgagtttttttggcaatcatttcagagagatcattaggggaaactaaccatatttttttcttccctcgaggaaatcttcgagaaccagctgttaagggacctccagtttaccttctgggcgtcgcagtttaactgaatctaaagccacttttcgtttctcctctacagatgtcataacggtagccaaaagtaatgaacaacggcttataaatagtttgtaggacgaaaccatacagcattgtgccaagtgaaatgaaaaaaaaaaaaaa

SEQ ID NO: 277 - protein, 291 aa, Homo sapiens
MSMLPTFGFTQEQVACVCEVLQQGGNIERLGRFLWSLPACEHLHKNESVLKAKAVVAFHRGNFRELYKILESHQFSPHNHAKLQQLWLKAHYIEAEKLRGRPLGAVGKYRVRRKFPLPRSIWDGEETSYCFKEKSRSVLREWYAHNPYPSPREKRELAEATGLTTTQVSNWFKNRRQRDRAAEAKERENNENSNSNSHNPLNGSGKSVLGSSEDEKTPSGTPDHSSSSPALLLSPPPPGLPSLHSLGHPPGPSAVPVPVPGGGGADPLQHHHGLQDSILNPMSANLVDLGS

SEQ ID NO: 278 - DNA, 2206 bp, Homo sapiens
aagaaagctgagagccagctagacgggagggagaacgagtgagaagcgagcgagggaacggcgggcgggcgcggagcatgcggagcggcgccccgggcggcccccgggcttgggcgagggcttgggccaggcgcgcgggccgttggggttcggagcttcgtgggacccgcggccggcgcggggacgtacggcagtgactcggggctcaccgggggccagtgccgggccagggggccagccccgcccgcgtctcggcccggacggcccggcgaggaagctcccatgcgggaccgcgcggcccggtgagggcgcgcgcgggcgggcggggacgcagccggcaccatgtccatgctgcccaccttcggcttcacgcaggagcaagtggcgtgcgtgtgcgaggtgctgcagcagggcggcaacatcgagcggctgggccgcttcctgtggtcgctgcccgcctgcgagcaccttcacaagaatgaaagcgtgctcaaggccaaggccgtggtggccttccaccgcggcaacttccgcgagctctacaagatcctggagagccaccagttctcgccgcacaaccacgccaagctgcagcagctgtggctcaaggcacactacatcgaggcggagaagctgcgcggccgacccctgggcgccgtgggcaaataccgcgtgcgccgcaaattcccgctgccgcgctccatctgggacggcgaggagaccagctactgcttcaaggaaaagagtcgcagcgtgctgcgcgagtggtacgcgcacaacccctacccttcaccccgcgagaagcgtgagctggcggaggccacgggcctcaccaccacacaggtcagcaactggttcaagaaccggcggcagcgcgaccgggcggccgaggccaaggaaagggagaacaacgagaactccaattctaacagccacaacccgctgaatggcagcggcaagtcggtgttaggcagctcggaggatgagaagactccatcggggacgccagaccactcatcatccagccccgcactgctcctcagcccgccgccccctgggctgccgtccctgcacagcctgggccaccctccgggccccagcgcagtgccagtgccggtgccaggcggaggtggagcggacccactgcaacaccaccatggcctgcaggactccatcctcaaccccatgtcagccaacctcgtggacctgggctcctagaacccatttgccttgatgagcttgccttttgtgacttgacactggggacgtggagtggcggtgtccaggggcgccccgcccctgcggccccaccaggtactgaaagacccgcaggctgagcgggtagaacagccgggtagggcagatagctgtctatgttggttcttgtttgggatttattttcaacaagttacttttaggatccttttggggctggagactgagtcttgaaccacagaagggaataaattatacaccactgtcattctctctctccctctgtctcttccttttaccctctcttgtcttgccttttccccctttcctcttcctttcccttccttctcttttcttttttctgctttctgtctttctccctctccttgtattgctttccttctagatttctagcttgccaccgttcattctctccttctgtctctccctttctctctccttctctgtttctcctctcttctctcctgccagtctcttgtactctgtgtcctggtccctccgtatgtacccctgtctttctcctcctgactggtggtctatctgcccctacctctggccctcgctttaccggagtagggggtgggagagggaagaggagagaaaatacagggactttgaacctaggccatctcctgaggccttttccctcgcccatgtgggtcagtgggagctgcaggtgtcagcttttcgtctagtaacttaagtgagagagaaagggcagcgccacagaagcccctaaacgccgcctcgtcatacgcccctcctccttctctcttggcgaggccccgccacaccgcgctcttcctcccgggactgtgactacagcgctcccggctgagcgcgccccccgagccgccgacttgccgtctccccgtaatgccctcatgtgaatgttcttcgggaaatatttctgcttttattttataataaaattagaaatcataaatatataaatggttatatgccacaa

SEQ ID NO: 279 - protein, 592 aa, Homo sapiens
MEMQDLTSPHSRLSGSSESPSGPKLGNSHINSNSMTPNGTEVKTEPMSSSETASTTADGSLNNFSGSAIGSSSFSPRPTHQFSPPQIYPSNRPYPHILPTPSSQTMAAYGQTQFTTGMQQATAYATYPQPGQPYGISSYGALWAGIKTEGGLSQSQSPGQTGFLSYGTSFSTPQPGQAPYSYQMQGSSFTTSSGIYTGNNSLTNSSGFNSSQQDYPSYPSFGQGQYAQYYNSSPYPAHYMTSSNTSPTTPSTNATYQLQEPPSGITSQAVTDPTAEYSTIHSPSTPIKDSDSDRLRRGSDGKSRGRGRRNNNPSPPPDSDLERVFIWDLDETIIVFHSLLTGSYANRYGRDPPTSVSLGLRMEEMIFNLADTHLFFNDLEECDQVHIDDVSSDDNGQDLSTYNFGTDGFPAAATSANLCLATGVRGGVDWMRKLAFRYRRVKEIYNTYKNNVGGLLGPAKREAWLQLRAEIEALTDSWLTLALKALSLIHSRTNCVNILVTTTQLIPALAKVLLYGLGIVFPIENIYSATKIGKESCFERIIQRFGRKVVYVVIGDGVEEEQGAKKHAMPFWRISSHSDLMALHHALELEYL

SEQ ID NO: 280 - DNA, 4163 bp, Homo sapiens
ctcagatgctatctgccgctgctgtttggtggggaaggagcgctgggcgcaaagctgttaccaaacagaacggtgggagctgatggctccgagtttggggcgaggtagaaactctccagtgccacttccgactttaagccttcctgttgccgtccactgtggcgggtttcttcctggggaacacgttttcgctcagtcgctcggcagcccgagcctgcggcagcggccaggcgcctgccccctgcgccgagctttcccctgcagaggcgctccactcccagaagcgccgcggctgcaccagagcgcctgagagcccccgcgcgtacccatccaggagcaaaactatgtcaggaatggaggtttgctaacccagaaaattcgaaggaacacattaaactggtggatgcagcagatgtaagcgctgtgcaaacatctcaagccagttcagatgttgctgtttcctcaagttgcaggtctatggaaatgcaggatctaaccagcccgcatagccgtctgagtggtagtagtgaatcccccagtggccccaaactcggtaactctcatataaatagtaattccatgactcccaatggcaccgaagttaaaacagagccaatgagcagcagtgaaacagcttcaacgacagccgacgggtctttaaacaatttctcaggttcagcaattgggagcagtagtttcagcccacgaccaactcaccagttctctccaccacagatttacccttccaacagaccatacccacatattctccctaccccttcctcacaaactatggctgcatatgggcaaacacagtttaccacaggaatgcaacaagctacagcctatgccacgtacccacagccaggacagccgtacggcatttcctcatatggtgcattgtgggcaggcatcaagactgaaggtggattgtcacagtctcagtcacctggacagacaggatttctcagctatggcacaagcttcagtacccctcaacctggacaggcaccatacagctaccagatgcaaggtagcagttttacaacatcatcaggaatatatacaggaaataattcactcacaaattcctctggatttaatagttcacagcaggactatccgtcttatcccagttttggccagggtcagtacgcacagtattataacagctcaccgtatccagcacattatatgaccagcagcaacaccagcccaacgacaccatccaccaatgccacttaccagcttcaagaaccgccatctggcatcaccagccaagcagttacagatcccacagcagagtacagcacaatccacagcccatcaacacccattaaagattcagattctgatcgattgcgtcgaggttcagatgggaaatcacgtggacggggccgaagaaacaataatccttcacctcccccagattctgatcttgagagagtgttcatctgggacttggatgagacaatcattgttttccactccttgcttactgggtcctacgccaacagatatgggagggatccacccacttcagtttcccttggactgcgaatggaagaaatgattttcaacttggcagacacacatttattttttaatgacttagaagaatgtgaccaagtccatatagatgatgtttcttcagatgataacggacaggacctaagcacatataactttggaacagatggctttcctgctgcagcaaccagtgctaacttatgtttggcaactggtgtacggggcggtgtggactggatgagaaagttggccttccgctacagacgggtaaaagagatctacaacacctacaaaaataatgttggaggtctgcttggtccagctaagagggaagcctggctgcagttgagggccgaaattgaagccctgaccgactcctggttgacactggccctgaaagcactctcgctcattcactcccggacaaactgtgtgaatattttagtaacaactactcagctcatcccagcattggcgaaagtcctgctgtatgggttaggaattgtatttccaatagaaaatatttacagtgcaactaaaataggaaaagaaagctgttttgagagaataattcaaaggtttggaagaaaagtggtgtatgttgttataggagatggtgtagaagaagaacaaggagcaaaaaagcacgcgatgcccttctggaggatctccagccactcggacctcatggccctgcaccatgccttggaactggagtacctgtaacagcgctcggcactttgacagcgcacagctgctctgtgaccagggacagatccagcaggccccagtctcgcatcagcgccggcctccagaacttagcaatttccgcctggtgatgcgcagttgctgtcagtcttgacctctgcctttgtggtgaatggaggaccacgtctatttcatcagaacagctgttgactctagtactgtgaatccagtgaaaataagccatgagaatgttttagcacagcgttatgtgtctgccacattaactacacggttcaaacctgtgaagaaaggacctgcaaacgcttcagttgttagcattttcaatgtgatataaacagcttctccaatacagcaaacctaattgcacaacagagactgaaatgtgtttcctgaataccagtggaggaattttcttgtaaagaaggtttactttttggtgtctcatacccagggtaatctgtacatctctacttatttatgaacagactttttttaaaaagataaaaaaacagctttattgaggtataattcacccaccagacttttttaaacatcaaataattgaagagacaatagcattagaaataagtgattaaaggcctctgcctcacaacatggcaagtacagtactttgaattttagcacattgcatagtagttttaagtatgtctaatttaaacgtataatatgtacatcactgagacaatcatgtacagaaagaatttttggtgtaaatttgtaataatggataattcttttacatattgtttagggaaatgatattgaaaggtagcaatgcctggatagtgaagcatgaggcagcacgtgcacaaattcatgtgccgtgccttatctgagttttcggtataaatatgtagataatggattttttttttttagataatgttgtcaagaccaaaagcatggatgtcaagtgtcagtaaggattttgttttctaaaattttttcctgcatcagttcttctgagggccttgatgaaataacacagcagtttcttaaacaatttgaaacaaaatgagctctcctaccacctcactttttcatttccacactaatgtattatatgtaactacttggaaaaaataattattcaaatgcttcttcccacaaagaatatagatgatagtagatatattttattaataaaatggttcatgaatcggagactaacaaagttttcatgtgctcagaattattaattatcgtgtctgcattttctttcgataaaggaagacacacgatgctaatccggaaatcagcaaactttgcattactccctatgtgcgtattttctctttcttcctgtcaccctgaggaaggttcattgccattgtcatcaccatggaaacaacgttcctctccacctgcattatgtactacatgacaggcatcaatctggggaaataataaaattatcacctttgtcagaccataagagtttctccaaaagtggtcagtttggctgggcaatattttctctcatctaacaaacacaatccattgtcatgaaattacccttaggatgagtcttctttaatcaatcatatattgggcgggaaaaacaccagctttgacccgaagtagttgaagagctacttcattcttttctgaagttgtgtgttgctgctagaaatagtcatttgtgaattatccaaattgtttaaattcacaattgaattagttttttcttcctttttgcttgaagcaaacagttgacaatttttaaccttttcattttatgtttttgtactctgcagactgaaaagacaaagtttatcttggccttactgtataaaggtgtgctgtgtccaccgttgtgtacagaatttttcttcattaattttgtgtttaagttaataaaatttatttgtgatgtactgtaa

SEQ ID NO: 281 - protein, 538 aa, Homo sapiens
MVELVISPSLTVNSDCLDKLKFNRADAAVWTLSDRQGITKSAPLRVSQLFSRSCPRVLPRQPSTAMAAYGQTQYSAGIQQATPYTAYPPPAQAYGIPSYSIKTEDSLNHSPGQSGFLSYGSSFSTSPTGQSPYTYQMHGTTGFYQGGNGLGNAAGFGSVHQDYPSYPGFPQSQYPQYYGSSYNPPYVPASSICPSPLSTSTYVLQEASHNVPNQSSESLAGEYNTHNGPSTPAKEGDTDRPHRASDGKLRGRSKRSSDPSPAGDNEIERVFVWDLDETIIIFHSLLTGTFASRYGKDTTTSVRIGLMMEEMIFNLADTHLFFNDLEDCDQIHVDDVSSDDNGQDLSTYNFSADGFHSSAPGANLCLGSGVHGGVDWMRKLAFRYRRVKEMYNTYKNNVGGLIGTPKRETWLQLRAELEALTDLWLTHSLKALNLINSRPNCVNVLVTTTQLIPALAKVLLYGLGSVFPIENIYSATKTGKESCFERIMQRFGRKAVYVVIGDGVEEEQGAKKHNMPFWRISCHADLEALRHALELEYL

SEQ ID NO: 282 - DNA, 2483 bp, Homo sapiens
agcagccgcggcagcccaggaggcggaggcagcggcaacggcagagacagcaacgtgcccgccgcagtcagcccggcctcgtcggacccgcaccggcccgcccgcccgcccgcaccgcgtcggggcgccctctccactgcgcgcggtacaaggaaatggtagaactagtgatctcacccagcctcactgtaaacagcgattgtctggataaactgaagtttaaccgtgctgacgctgctgtgtggactctgagtgacagacaaggcatcaccaaatcggcccccctgagagtgtcccagctcttctccagatcttgcccacgtgtcctcccccgccagccttccacagccatggcagcctacggccagacgcagtacagtgcggggatccagcaggctaccccctatacagcttacccacctccagcacaagcctatggaatcccttcctacagcatcaagacagaagacagcttgaaccattcccctggccagagtggattcctcagctatggctccagcttcagcacctcacccactggacagagcccatacacctaccagatgcacggcacaacagggttctatcaaggaggaaatggactgggcaacgcagccggtttcgggagtgtgcaccaggactatccttcctaccccggcttcccccagagccagtacccccagtattacggctcatcctacaaccctccctacgtcccggccagcagcatctgcccttcgcccctctccacgtccacctacgtcctccaggaggcatctcacaacgtccccaaccagagttccgagtcacttgctggtgaatacaacacacacaatggaccttccacaccagcgaaagagggagacacagacaggccgcaccgggcctccgacgggaagctccgaggccggtctaagaggagcagtgacccgtccccggcaggggacaatgagattgagcgtgtgttcgtgtgggacttggatgagacaataattatttttcactccttactcacggggacatttgcatccagatacgggaaggacaccacgacgtccgtgcgcattggccttatgatggaagagatgatcttcaaccttgcagatacacatctgttcttcaatgacctggaggattgtgaccagatccacgttgatgacgtctcatcagatgacaatggccaagatttaagcacatacaacttctccgctgacggcttccacagttcggccccaggagccaacctgtgcctgggctctggcgtgcacggcggcgtggactggatgaggaagctggccttccgctaccggcgggtgaaggagatgtacaatacctacaagaacaacgttggtgggttgataggcactcccaaaagggagacctggctacagctccgagctgagctggaagctctcacagacctctggctgacccactccctgaaggcactaaacctcatcaactcccggcccaactgtgtcaatgtgctggtcaccaccactcaactaattcctgccctggccaaagtcctgctatatggcctggggtctgtgtttcctattgagaacatctacagtgcaaccaagacagggaaggagagctgcttcgagaggataatgcagagattcggcagaaaagctgtctacgtggtgatcggtgatggtgtggaagaggagcaaggagcgaaaaagcacaacatgcctttctggcggatatcctgccacgcagacctggaggcactgaggcacgccctggagctggagtatttatagcaggatcagcagcatctccacctgccatctcaccctcagaccccctcgccttccccacctccccaccgagaactccagagacccagatgttggacaccaggaaggggccccacagccgagacgacgtgtccagtgaccatctcagaagccgtccatcagtccaaatgggggttctgagaaggaaagtacccaacattggcttcggagtatttgactttggggaaaagggctggctcggagtctagactcttctgtaagactcacagaacaaaagcaaggaattgctgatttggggggtgcctggtgatgaggaggggatgggtttgtcttgtcttctttttaatttatggactagtctcattactccggaattatgctcttgtacctgtgtggctgggtttcttagtcgttggtttggtttggttttttgaactggtatgtggggtggttcacagttctaatgtaagcactctattctccaagttgtgctttgtggggacaatcattctttgaacattagagaggaaggcagttcaagctgttgaaaagactattgcttatttttgtttttaaagacctacttgacgtcatgtggacagtgcacgtgccttacgctacatcttgttttctaggaagagggggatgctgggaaggaatgggtgctttgtgatggataaaaggcattaaataaaaccacgtttacattttgaa

SEQ ID NO: 283 - protein, 484 aa, Homo sapiens
MERRMKAGYLDQQVPYTFSSKSPGNGSLREALIGPLGKLMDPGSLPPLDSEDLFQDLSHFQETWLAEAQVPDSDEQFVPDFHSENLAFHSPTTRIKKEPQSPRTDPALSCSRKPPLPYHHGEQCLYSSAYDPPRQIAIKSPAPGALGQSPLQPFPRAEQRNFLRSSGTSQPHPGHGYLGEHSSVFQQPLDICHSFTSQGGGREPLPAPYQHQLSEPCPPYPQQSFKQEYHDPLYEQAGQPAVDQGGVNGHRYPGAGVVIKQEQTDFAYDSDVTGCASMYLHTEGFSGPSPGDGAMGYGYEKPLRPFPDDVCVVPEKFEGDIKQEGVGAFREGPPYQRRGALQLWQFLVALLDDPTNAHFIAWTGRGMEFKLIEPEEVARLWGIQKNRPAMNYDKLSRSLRYYYEKGIMQKVAGERYVYKFVCEPEALFSLAFPDNQRPALKAEFDRPVSEEDTVPLSHLDESPAYLPELAGPAQPFGPKGGYSY

SEQ ID NO: 284 - DNA, 2335 bp, Homo sapiens
gctcacaactgtctgctgcgcccgaaaaacaagtcggtgcgctggggacccggggccggggccgccttactccggcctagccccgcggccctcggtgcgggctccagggcatgctcgggaccccccgcggctccagcccagacgccccggcctcaggtctcggcccccgcttggggccccggccgtgcggccggagggagcggccggatggagcggaggatgaaagccggatacttggaccagcaagtgccctacaccttcagcagcaaatcgcccggaaatgggagcttgcgcgaagcgctgatcggcccgctggggaagctcatggacccgggctccctgccgcccctcgactctgaagatctcttccaggatctaagtcacttccaggagacgtggctcgctgaagctcaggtaccagacagtgatgagcagtttgttcctgatttccattcagaaaacctagctttccacagccccaccaccaggatcaagaaggagccccagagtccccgcacagacccggccctgtcctgcagcaggaagccgccactcccctaccaccatggcgagcagtgcctttactccagtgcctatgacccccccagacaaatcgccatcaagtcccctgcccctggtgcccttggacagtcgcccctacagccctttccccgggcagagcaacggaatttcctgagatcctctggcacctcccagccccaccctggccatgggtacctcggggaacatagctccgtcttccagcagcccctggacatttgccactccttcacatctcagggagggggccgggaacccctcccagccccctaccaacaccagctgtcggagccctgcccaccctatccccagcagagctttaagcaagaataccatgatcccctgtatgaacaggcgggccagccagccgtggaccagggtggggtcaatgggcacaggtacccaggggcgggggtggtgatcaaacaggaacagacggacttcgcctacgactcagatgtcaccgggtgcgcatcaatgtacctccacacagagggcttctctgggccctctccaggtgacggggccatgggctatggctatgagaaacctctgcgaccattcccagatgatgtctgcgttgtccctgagaaatttgaaggagacatcaagcaggaaggggtcggtgcatttcgagaggggccgccctaccagcgccggggtgccctgcagctgtggcaatttctggtggccttgctggatgacccaacaaatgcccatttcattgcctggacgggccggggaatggagttcaagctcattgagcctgaggaggtcgccaggctctggggcatccagaagaaccggccagccatgaattacgacaagctgagccgctcgctccgatactattatgagaaaggcatcatgcagaaggtggctggtgagcgttacgtgtacaagtttgtgtgtgagcccgaggccctcttctctttggccttcccggacaatcagcgtccagctctcaaggctgagtttgaccggcctgtcagtgaggaggacacagtccctttgtcccacttggatgagagccccgcctacctcccagagctggctggccccgcccagccatttggccccaagggtggctactcttactagcccccagcggctgttccccctgccgcaggtgggtgctgccctgtgtacatataaatgaatctggtgttggggaaaccttcatctgaaacccacagatgtctctggggcagatccccactgtcctaccagttgccctagcccagactctgagctgctcaccggagtcattgggaaggaaaagtggagaaatggcaagtctagagtctcagaaactcccctgggggtttcacctgggccctggaggaattcagctcagcttcttcctaggtccaagccccccacaccttttccccaaccacagagaacaagagtttgttctgttctgggggacagagaaggcgcttcccaacttcatactggcaggagggtgaggaggttcactgagctccccagatctcccactgcggggagacagaagcctggactctgccccacgctgtggccctggagggtcccggtttgtcagttcttggtgctctgtgttcccagaggcaggcggaggttgaagaaaggaacctgggatgaggggtgctgggtataagcagagagggatgggttcctgctccaagggaccctttgcctttcttctgccctttcctaggcccaggcctgggtttgtacttccacctccaccacatctgccagaccttaataaaggcccccacttctccca

SEQ ID NO: 285 - protein, 1548 aa, Homo sapiens
MPSDFISLLSADLDLESPKSLYSRDSLKLHPSQNFHRAGLLEESVYDLLPKELQLPPSRETSVASMSQTSGGEAGSPPPAVVAADASSAPSSSSMGGACSSFTTSSSPTIYSTSVTDSKAMQVESCSSAVGVSNRGVSEKQLTSNTVQQHPSTPKRHTVLYISPPPEDLLDNSRMSCQDEGCGLESEQSCSMWMEDSPSNFSNMSTSSYNDNTEVPRKSRKRNPKQRPGVKRRDCEESNMDIFDADSAKAPHYVLSQLTTDNKGNSKAGNGTLENQKGTGVKKSPMLCGQYPVKSEGKELKIVVQPETQHRARYLTEGSRGSVKDRTQQGFPTVKLEGHNEPVVLQVFVGNDSGRVKPHGFYQACRVTGRNTTPCKEVDIEGTTVIEVGLDPSNNMTLAVDCVGILKLRNADVEARIGIAGSKKKSTRARLVFRVNIMRKDGSTLTLQTPSSPILCTQPAGVPEILKKSLHSCSVKGEEEVFLIGKNFLKGTKVIFQENVSDENSWKSEAEIDMELFHQNHLIVKVPPYHDQHITLPVSVGIYVVTNAGRSHDVQPFTYTPDPAAGALNVNVKKEISSPARPCSFEEAMKAMKTTGCNLDKVNIIPNALMTPLIPSSMIKSEDVTPMEVTAEKRSSTIFKTTKSVGSTQQTLENISNIAGNGSFSSPSSSHLPSENEKQQQIQPKAYNPETLTTIQTQDISQPGTFPAVSASSQLPNSDALLQQATQFQTRETQSREILQSDGTVVNLSQLTEASQQQQQSPLQEQAQTLQQQISSNIFPSPNSVSQLQNTIQQLQAGSFTGSTASGSSGSVDLVQQVLEAQQQLSSVLFSAPDGNENVQEQLSADIFQQVSQIQSGVSPGMFSSTEPTVHTRPDNLLPGRAESVHPQSENTLSNQQQQQQQQQQVMESSAAMVMEMQQSICQAAAQIQSELFPSTASANGNLQQSPVYQQTSHMMSALSTNEDMQMQCELFSSPPAVSGNETSTTTTQQVATPGTTMFQTSSSGDGEETGTQAKQIQNSVFQTMVQMQHSGDNQPQVNLFSSTKSMMSVQNSGTQQQGNGLFQQGNEMMSLQSGNFLQQSSHSQAQLFHPQNPIADAQNLSQETQGSLFHSPNPIVHSQTSTTSSEQMQPPMFHSQSTIAVLQGSSVPQDQQSTNIFLSQSPMNNLQTNTVAQEAFFAAPNSISPLQSTSNSEQQAAFQQQAPISHIQTPMLSQEQAQPPQQGLFQPQVALGSLPPNPMPQSQQGTMFQSQHSIVAMQSNSPSQEQQQQQQQQQQQQQQQQQSILFSNQNTMATMASPKQPPPNMIFNPNQNPMANQEQQNQSIFHQQSNMAPMNQEQQPMQFQSQSTVSSLQNPGPTQSESSQTPLFHSSPQIQLVQGSPSSQEQQVTLFLSPASMSALQTSINQQDMQQSPLYSPQNNMPGIQGATSSPQPQATLFHNTAGGTMNQLQNSPGSSQQTSGMFLFGIQNNCSQLLTSGPATLPDQLMAISQPGQPQNEGQPPVTTLLSQQMPENSPLASSINTNQNIEKIDLLVSLQNQGNNLTGSF

SEQ ID NO: 286 - DNA, 13285 bp, Homo sapiens
agattcctgtcagcggcggcggcggtggcggcgaccgtcagttttcgctgaggagaaacacgaaacggaccctttggctctcccccttccccttccccgtcctgaacccctctcctggtcaccgagaatcagtccccgtggagttccccctccacctcgccatcgtttcctcggtcctcggcccagtggaagtcactaccctcgaggaggaggcagcggcagccgccctcgcgtcgccgcccccggttcggtgcccgcggtcccggagaggaggtgccgccgccaccgccgctccccccctcccgctgccctcgggccgggctgggtcgagctgcgatgccctcggacttcatctcattgctcagcgcggacctagacctggaatcgcccaagtccctctactcgcgagattctctgaagttacacccatcacagaattttcatagagctggactattggaagaatctgtctatgatcttctcccaaaggagttacagttacctccatctagagaaacatctgtagcatcaatgagtcagacaagcggtggtgaggcaggctcgcctcctccagctgttgttgctgctgatgcttcttcagctccctcctcttcctccatgggcggtgcttgcagctcctttaccacctcttccagccctaccatttattctacctcagtcaccgacagcaaggctatgcaagtggagagctgctcctcagccgtgggggtaagtaacagaggggtaagtgaaaagcagttaaccagtaacacagttcagcagcatccatcaacaccgaagaggcacacagtcttgtacatctcaccaccacctgaggacttgctggataacagtcggatgtcctgccaggatgaggggtgtggattggaatctgagcagagctgcagtatgtggatggaggattccccctccaacttcagtaacatgagcaccagttcctacaatgataacactgaggtacctcgtaaatcacgaaaacgaaatccaaagcagaggccgggggtcaaacgacgagattgtgaagaatctaatatggatatatttgatgccgacagtgccaaagcacctcactatgtgctttctcagcttaccacggacaacaaaggcaactcaaaagcgggaaatggaacattggaaaaccaaaaaggaactggagtaaagaagagccctatgttgtgtggacaatatcctgttaaaagtgagggaaaggagctgaagatagttgtacaacctgagacacagcaccgagctcggtacctgactgagggcagccgtggctcagtgaaagatagaacacagcaaggctttcctacagtaaagctggaaggccataatgaacctgtagtgttgcaagtgtttgtgggcaacgactctggacgagtgaaaccacatggattttatcaggcctgcagagtaactggacgaaatacaactccttgcaaagaagtggacattgaaggcactactgttatagaagtcggccttgatcctagcaacaacatgacactggcggtggactgcgtagggatattgaaattgaggaatgctgatgtcgaagccagaataggaattgctggttccaagaagaaaagcactcgtgccagattggtttttcgagttaatatcatgaggaaagatggctccactttgacactgcaaacaccctcttctccaattttgtgtactcagccagcaggagtgccagaaatcttaaagaaaagcttgcatagctgttcagtgaaaggagaagaagaagtgtttttaatcggcaagaactttctgaaaggaactaaagttattttccaagaaaatgtttctgatgaaaactcttggaagtcagaagctgaaattgatatggaactatttcatcagaatcatcttattgtgaaggttcctccctatcatgaccaacatataactttgcctgtgtcagtgggaatatatgtagtgacaaatgctggaagatctcatgatgttcaaccattcacttacactccagacccagcagctggtgctttgaatgtaaatgtgaagaaggaaatatctagtccagcaagaccttgctcttttgaagaggccatgaaagcaatgaaaactactggatgtaatttagataaggtaaatattatccctaatgccctgatgactccactcataccaagcagtatgattaagagtgaagatgttactccaatggaagtaacagcagaaaaaagatcttccactatttttaagactacaaagtctgttggatcaactcagcaaacattagaaaacatctcaaacatagcaggaaatggctctttttcatcaccatcatcttcccacctaccttctgaaaatgaaaaacagcagcagattcagcccaaggcatacaacccagagaccctgacaactattcaaacccaggacatctcacagcctggtacttttccagcagtttctgcttctagtcagctgcccaacagcgatgcactattgcagcaggctacacagtttcagacaagagaaactcagtctagagagatattacagtcagatggtacagtggttaatttgtcacaactgactgaggcatcacaacaacagcagcagtcaccactacaagaacaagcacagactttacagcagcagatttcatcaaatatttttccatcaccaaatagtgtgagtcagcttcagaatactattcagcagctgcaagcagggagtttcacaggcagtactgctagtggcagcagtggaagtgttgacttggtccaacaagttttagaggcacagcagcagttatcttcagttttattttctgctccagatggtaatgagaatgttcaagagcagcttagtgcagatatttttcaacaagtcagtcaaattcagagtggtgtaagccctggaatgttttcctcaacagagccaacagtccataccagaccagataatttattacctggaagagctgaaagtgttcatccacagtctgaaaacacgttatctaatcaacagcagcagcagcagcagcaacagcaagtgatggaatcttcagccgcaatggtgatggagatgcaacagagtatctgccaggcagctgcccagattcagtcagagttattcccttcaactgcttcagcaaatggaaaccttcagcaatcgccagtttaccagcagacttctcacatgatgagtgcattgtctaccaatgaggatatgcaaatgcagtgtgaattgttttcttctcctcctgcagtttctggaaatgaaacttctacaactaccacacagcaggttgcaacccctggcactaccatgtttcagacatcaagttcaggagatggagaagaaactggaacacaagcaaaacagattcagaacagtgtctttcagaccatggtccaaatgcaacatagtggggacaatcaacctcaagttaaccttttttcatccacaaaaagtatgatgagtgttcagaatagtggtacccaacaacaaggtaatggtttattccagcaagggaatgagatgatgtcacttcaatctggaaattttttgcagcagtcttctcattcacaggcccaactttttcatcctcaaaatcctattgccgatgctcagaacctttcccaggaaactcaaggttctctctttcatagtccaaatcctattgtccacagtcagacttctacaacctcctctgaacaaatgcagcctccaatgtttcactctcaaagtaccattgctgtgttacagggctcttcagttcctcaagaccagcagtcaaccaacatatttctttcccagagtcccatgaataatcttcagactaacacagtagcccaagaagcattttttgcagcaccgaactcaatttctccacttcagtcaacatcaaacagtgaacaacaagctgctttccaacagcaagctccaatatcacacatccagactcctatgctttcccaagaacaggcacaacccccgcagcagggtttatttcagcctcaggtggccctgggctcccttccacctaatccaatgcctcaaagccaacaaggaaccatgttccagtcacagcactcaatagttgccatgcagagtaactctccatcccaggaacagcagcagcagcagcaacagcagcagcaacagcagcagcaacaacaacagagcattttattcagtaatcagaataccatggctacaatggcgtctccaaagcaaccaccaccaaacatgatattcaacccaaatcaaaatccaatggctaatcaggagcaacagaaccagtcaatttttcaccaacaaagtaacatggccccaatgaatcaagagcaacagcccatgcaatttcagagtcagtccacagtttcctcacttcagaacccaggtcctacccagtcggaatcatcacagacccccttgttccatagctctcctcagattcagttggtacaagggtcacctagttctcaagagcagcaagtaactctcttcttatctccagcatccatgtctgccttgcagaccagtataaatcaacaagatatgcaacagtctcctctttattcccctcagaacaacatgcctggaattcaaggagccacatcttcgcctcaaccacaggctactttatttcacaacacagcaggaggcacaatgaaccaactgcagaattctcctggctcatctcagcagacatcaggaatgttcttatttggcattcaaaataactgtagtcagcttttaacctctggaccagctacattgcctgatcagttgatggccataagtcagccaggccaaccacaaaacgagggccagccacctgtgacaacacttctttctcagcaaatgccagagaattctccactggcatcctctataaacaccaaccagaacatcgaaaagattgatttgcttgtttcattgcaaaaccaagggaacaacttgactggctccttttaactggatataaattccacgaagaaaatcctgattccaagatgtcctgagatcttgtggttccatgagaattattactttaaaaacaaaacaaaatataaaaaactgtgtttgagtaaactgatagattttactctgactgcaaaagagcacacctatgctgcttgttgcagtaactaaccaccaatgttaacatcttcatattttatattcctaataacagtgatgactgagaatctatttgagtttccagctggcagaattaattgttattattttcctaggcgcaatttccttaaacgtacagtttaaattcaaggctggaccactcagttattattgctattagaaaataatatatcatgtttacttttgttcttcattattttctttcctgcattgttttagtcaagtaatggcttttgaaaaagtaaagttcaataataactaaggctgtgatttttttcaatataaaaggcacagctgttggccaaagtgaaggaatcttttttcagttttattggagaaactgaagggtaacattctaacaagtaaactgtatgtgcagataaaagtactcttgatttaacacaaaggcagatgatacacttataaaactgggaacagctggaatgcttcttgattttattttttcagagagttgttagttctctgggtttctactaaggggtttagccataactgtgcatagaaaaataattatctgtaaaaaatgaaggggataatatatgataaattatgttctgatatcctcctacagtagtttaaattgacagaaaaatttgaatgttttcttcttaacccagtcttaggctggtattccctttttatatatatctatattacttttcacctctttttcactttactttagagaactattaatatactactggcttcatgaccctgtagcatctttggccactttaatctagggtgacctagcaatcctgcagcacagggcagagagtactgtcttaggaattattaggagttgattcctgagaaacaacacatttttccccatgaacggtgctgttctgaagtcttcaaatttttccctctaataggaaacagtataaattttaattaaaaaaaaaaggcaaactaaaatttcttgaaatatcacttctccctgatctgcagtgagtataaattcacttgtcacctcagtgctttacagtttgaagtggtcacttacctgatggttcccacaagccttaggctttacagggttgtatcattgacttaaaatgaagaattaacttgtgttacatctataaagagcaaaataacacactccagaacttggcagttgtagcattagttatacagttttgggtgttcttgccacccgtgggatgcctgcttctcactaccacctgtgtctggacacatgcttatgtctcattttccttttggcatgtggaaagctgtcaatgcagtgtaaggccaacgtgtgtgtggcttctatgtgttgagataatgttttggtatccttgtccgtttcatttattttttaagtgtacaaaaaataacctgttaattgttgaaggctacttttctgttctttttttttttttttttctatcctgtacatttagttgaactgtgcggaattgtggtgttggttttgtttacacagccagatttttccttctttttgttttgtgatgatcttcctttgttctttgaatgtgctcttttgtctttttctcttttttctcatgttttcttccctccacctccacccctttctttctttctctctctgattgagaggcattgaattacgttttcagtagtacaggcttcttgccgatatgaagggaacttttcagaaagagacctactctgggtcatttaattttgaatacagttttcaatcgttcaagttttggatggtttatatctaatgtgtgtttcatttttttggaaagctatattttgtatttaggaaatggtatactattttgctatttgtactgagtgagtacattggcataaatatagaaatttatatatatacatatatataaactattcttttttgccacacatttttgtggtaaatttgtgagtttgtctgatgttctaccacaacgtggcgtctgataacagtgagggggggtggggtttgttatgtctttattgagtatttaagtatcttttgaaacaaatgacctgttcatctgtggccattccatcaggcagttagttccttgatgtcagtagtgggctaaaggcagcttactgtgtgtttgctggagctttcactcagccaagtgttagagtcaggaaacccattgaggcaatggcgtcaaatggtgtttcacaagaatgagccattcagtctttgctcactatatatttaatattttattattgttgttattgttattattaattggctttctgtattctatgccttttatttataaagacactaagaaaacccatgtttgtaattttaataacatttttcccatcttgtaatatccagagctactttataaattctctgaaccaaaagtattttcctcagtgtatctcttctcccccagcccctattgggaaaaattacccagtatagttcaggttatgaggaggatcagccacacaatccagtgcttcagtttgaaaatgtaaaattctaaccctaaagtagggttggttgaaatttcagacaaagcaaacccagcaggtataaaaagtagtataaatacaaatctgtaagttatttttgaattttctgaacttttttctaagagattacataggagactaaagaaatctatctgttcaagttctaattaggatgattgttaatactgcactgtggatgaagtggcgactggcttgtgtgctgacttctgtggtttagcaagaggtttattgttatcaaatgctaattggcaatgccaagtcactgggaccaattttctgttttataatatctaagtttagaacagaatatatacctgaactgtagtggtttgatcggatggagacagaaaacccgatttttattctcataaattttgtggttatttatacaagggctgtgctatgctaccatattcttgttcaataataataggtttgttgttttttttacattgttaaatgttccttacccctaaaggtcaatgttaagtacaacattctgaaaatacaatttggctacgaagagtattcatcttctttgaagctcagtggttgatatttgtgctaataatgcaatttcctgattactgttacaagttatagctacatatgggagagactcagtgagccagcaaaggccatagaaacaacaatttattaaatgtatttatggcagaaggacctaaataaactgtgagccaccttttcttctttatattgttacatttaagtgttcttgctttcagcaactcacattaatgcttggagcttatctctttctctctctctctctctctctctgtgtgtgtgtgtgtatgtgtgtgtgtgtgtgtgtgtgtttccttattgtcattccattatatatccacaccaacatgggtgacgataattcaaagtcatattttgcctctaagcttgatcatgttacctttatgattaaagtatcatgttatttagccaatgcaaatctgttttaaaacaaatagtttaaaaaaagaacaagtttttaagggctttattatagaagaagtattaatgaaggactttccttcctccctccctttcctcccctccctgcctcccttcttcccttccatctccccctcctccctgccttctttgtttctccttcccttattcctccctccctcctttctcccttccttcctttcttccattcatccttccttgccttttatttttattttttgtaatatcacatgtgctgtagtttggaattttattctagtgcatttcttgctcatcagaacctcagctaatctacctaggaaaaatagtatcaaaggaaatgagaaagttgtatctgagtccctccagaactaagataattctttttgaccatttaagcctttataaatgcgttttgaccatttaagcctttataaatgcttgttttaggaaagtgaatctgttagatgcatcaacaaataatgaccaggacaaaacgatttaataattaaagtctcaaatcaccatggttatacattttcaccagaaatagtaatcttacaatttttcatttttctgatgaagatttctgttccaatatctgtttcctaatagattttttaaattaattagctttcctctgctttatgaccacaggttttatccctaaccgagacagctgtcttatatctgcatgccttagactgtgtggagggactccatgaagaaagaccataggttagaaaaataactcatagtatataccctagtaagtgggttagtagaatctcataacatgtattaaaaagaggttttcttctctgcttgtttgtgtcactagagcaaaattgtagagataatgctcataatgcagtaaatatcagaataatatctacaatatcatttgtggatggtcccaggtcccagtgctctagttactttacttctttttttttttttgagatggagtcttgctctgtctctcaggctagagcagtgtgcgatctcagctcactgcagcctccacctcccaggttcaagcgattctcctgcctcagcctcccaagtagccaggattacaggcaccctccactaggcccggctaattttttttgtatttttttagtagagatggggttttgccatgttggccaggctggtttcgaactcctaacctccagtgatccacctgcctcggcgtcccaaagtgctaggattacaggcatgagccaccacatccggcctaattacttctttaatccccatttatttttatgccattctagcctcatttattaataaaattatgtttttactttctctttcaggaaattttttaaattaatattttatatctagatctaatgctatggaaaagtgcctttttatcatttataatttcatttttcactatttccaaaaacacataaacaaatagtttcagtaggtcccagcttttactttttccatttaaaccttcttttctccatttcttccctttggcttaagaataaaagaaaaggtacattgctagaattgtttctttgggagagggtaaaagattacagaattagactgttcagcctttatataaactaaatttgtcttcatctcaaccagctaatggtaggtcttatctgaatactcatgagaattttagcatctgtgaaactccatgcaccagatgtgtgtaaatttcaggaagaaagtgttgaaagcattttctctgatgttaattagatggaaataaatcactaaaacatagtttaggtaaagcctgattatgccacttttttttaactagacagggcaaagttgtttatgttagtgtacttcttgtctatcctcagttaatttacctagacaaaaagtgtcaaaggaaatgagaaaaaggttatatctgactccctccagacctaagataattcctttgatcagatacagtcagatggagtgccttggtttttgttaattttgcctctattccagctccttaccacagcggtggtgcttaaagaaaggatcatcagcaacaggtcaggatagttctacctttgggatagggctgctttccccgtgctagtatttctgtgactgttagtggcactgaggactgcaaacttttatgcaatattcttaataccctattgatattatgcactttaatcattccaaagaagccaagaatgctgtatagtgatgattccttcctaatgaattcatcttaactatttagaatgttatgtcccttttcttttggatagccaacttggtataaatgttatatggatttttctaaaatgactatataggacttaagactttgaaatgtaatttacttataaggggaaataattatgctttagcacatcattttagaaacgtcacattttagaaacattcagcttgctaacctacatgtttgggaattcattaaaaccagttgtctatatattttgtgccatgtatataagaacattacaatatatctttttctacatatgtagtatgtgcaaccagtggttctcagagtatggttctcagcccaccagctagtatcagtatcacctgggaactagttagaaatgtaaattctttggccccatcccagacatactgagtcagaaactctggaatagggcccccgcaatctgttttcacaagccctccaggtgattctgatgcacactttaaagtttaggaaccactgggctaagactctgttgagatatagagtttttcttccactcagactgatatagttatacattgttcttcatgtaaattcagcttaacctggttatctataatcttttattggcaaaagttaattctcagtactgcctatagagatacagtgtattttatgtacatacacaattagtctaattcttgataattcagttaatttagtttggcattttcctaccacttactaaaaggtttacattaaatgactgatttaaatatataggtgcaatgttctatgtttattttaattgttatgacatttaagtagctaatataattgaccggtgctaaagtctcctgtttatccataaaatgggtacattatgggcagtgtaatacaagctttcttttcattgcctagtactttaccagcagaccacagttttgccctggctagaccaaccctcagaacaaaatcatcattccttgtatttatatttgtatctgagatagtaaacaagatggctggccaggtcaacatggcaccttaacttatttttttaataggtaaaacttcttcaaaagtagcttgctttgtataagaactaagctatcagtatagatatagctatccttggagcttatgtttcagacaagaattatttactaaaataaataataaacaagataatgcattatacaatttgggcatttctcgtttctcaagtgtatgcatcatggtaaatataaactaaccacaagataggtagattgattcatttcattttaatctccttgtgtaattcagtacctccataattgttctaatcttcttcccactgtttacaaattaccagttaattaactcgtgaaagaaaaattcacatatcagaataaaaataaatgtatactcactttataaaaatcaccactgctgtctttccttaatactagcagtggaaatgtaagtggcttactctacaaattttggtgctggcaaatacataggcaaactgttgggagctgctctagttacattcctcccttcttattccctttttctcttcctcactttattgcataacatattcctgtacccaaagcattctaccacagttctatttgactcccacttgtaataactcctttaaaaaattccatgtttaaccatatgaccctgcttgcttactcatattctccctccctctccccttcctttctctctcttccagaagtcatttgcctggtttgaaatattttgtagggattgcttattatattattttagctgatgaacctcaggacaacgtctacacacacacacatacatacacgcacacaaaatctcagctgttgaagagtgggcttggaatcagacttctgtgtccagtaaaaaactcctgcactgaagtcattgtgacttgagtagttacagactgattccagtgaacttgatctaatttcttttgatctaatgaatgtgtctgcttaccttgtttccttttaattgataagctccaagtagttgctaattttttgacaactttaaatgagtttcattcacttcttttacttaatgttttaagtatagtaccaataatttcattaacctgttctcaagtggtttagctaccattctgccatttttaatttttatttaattttatttgcttgagcacactgatcaaccactgaactgccttcttccattgtcctgcaatgatataagggttacatttttgtgtatatggctttcatagttgggatttcagagcactgataccagatattttcagtttgttctctgggggaatttcatttgcatctatgtttttagctatctgtgataacttgttaaatattaaaaagatattttgcttctattggaacatttgtatactcgcaactatatttctgtaaacagctgcagtcaaaaataaaacactgaaagttttca

SEQ ID NO: 287 - protein, 706 aa, Homo sapiens
MASPADSCIQFTRHASDVLLNLNRLRSRDILTDVVIVVSREQFRAHKTVLMACSGLFYSIFTDQLKCNLSVINLDPEINPEGFCILLDFMYTSRLNLREGNIMAVMATAMYLQMEHVVDTCRKFIKASEAEMVSAIKPPREEFLNSRMLMPQDIMAYRGREVVENNLPLRSAPGCESRAFAPSLYSGLSTPPASYSMYSHLPVSSLLFSDEEFRDVRMPVANPFPKERALPCDSARPVPGEYSRPTLEVSPNVCHSNIYSPKETIPEEARSDMHYSVAEGLKPAAPSARNAPYFPCDKASKEEERPSSEDEIALHFEPPNAPLNRKGLVSPQSPQKSDCQPNSPTESCSSKNACILQASGSPPAKSPTDPKACNWKKYKFIVLNSLNQNAKPEGPEQAELGRLSPRAYTAPPACQPPMEPENLDLQSPTKLSASGEDSTIPQASRLNNIVNRSMTGSPRSSSESHSPLYMHPPKCTSCGSQSPQHAEMCLHTAGPTFPEEMGETQSEYSDSSCENGAFFCNECDCRFSEEASLKRHTLQTHSDKPYKCDRCQASFRYKGNLASHKTVHTGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSATDLPPELPKAC

SEQ ID NO: 288 - DNA, 3659 bp, Homo sapiens
acaagcgagctggtggttgaagctggttaaagaacagcctaggtattccagaagtgtttgaggatcccttccatgaaggaagagaggaaagtttttaagtaaacctcccactcccatgtgtcttcagctttcttttgcaaaggagaaaatccttgaagtttggtaaagaccgagttagtctatctctctttgcctatctcgagttgggctggggagaggaggagataggttcttttgtctttttctgtcttctcccttccccacttccttccctccagtccccactcactcacatgcacacactaaccttggagccgatgggattgagtgactggcacttgggaccacagagaaatgtcagagtgtttggttacagactcaaggaaacctctcattttagagtgctcatttggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggacttcatgtacacatctcggctcaatttgcgggagggcaacatcatggctgtgatggccacggctatgtacctgcagatggagcatgttgtggacacttgccggaagtttattaaggccagtgaagcagagatggtttctgccatcaagcctcctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacaatcccagaagaggcacgaagtgatatgcactacagtgtggctgagggcctcaaacctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaaccaagctgagtgccagcggggaggactccaccatcccacaagccagccggctcaataacatcgttaacaggtccatgacgggctctccccgcagcagcagcgagagccactcaccactctacatgcaccccccgaagtgcacgtcctgcggctctcagtccccacagcatgcagagatgtgcctccacaccgctggccccacgttccctgaggagatgggagagacccagtctgagtactcagattctagctgtgagaacggggccttcttctgcaatgagtgtgactgccgcttctctgaggaggcctcactcaagaggcacacgctgcagacccacagtgacaaaccctacaagtgtgaccgctgccaggcctccttccgctacaagggcaacctcgccagccacaagaccgtccataccggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccatgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggttgggggtggtgggggtcggggcctgggggactgggagccgcagcagctccccctcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttgtcaaagagagggctttaatttttttaaccaaaggtgaaggaatatatggcagagttgtaaatatataaatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaacaaaaagaacaaaaaaatctgcagaaggaaaaatgtgtaattttgttctagttttcagtttgtatatacccgtacaacgtgtcctcacggtgccttttttcacggaagttttcaatgatgggcgagcgtgcaccatccctttttgaagtgtaggcagacacagggacttgaagttgttactaactaaactctctttgggaatgtttgtctcatcccattctgcgtcatgcttgtgttataactactccggagacagggtttggctgtgtctaaactgcattaccgcgttgtaaaatatagctgtacaaatataagaataaaatgttgaaaagtcaaa

SEQ ID NO: 289 - protein, 320 aa, Homo sapiens
MELLSPPLRDVDLTAPDGSLCSFATTDDFYDDPCFDSPDLRFFEDLDPRLMHVGALLKPEEHSHFPAAVHPAPGAREDEHVRAPSGHHQAGRCLLWACKACKRKTTNADRRKAATMRERRRLSKVNEAFETLKRCTSSNPNQRLPKVEILRNAIRYIEGLQALLRDQDAAPPGAAAAFYAPGPLPPGRGGEHYSGDSDASSPRSNCSDGMMDYSGPPSGARRRNCYEGAYYNEAPSEPRPGKSAAVSSLDCLSSIVERISTESPAAPALLLADVPSESPPRRQEAAAPSEGESSGDPTQSPDAAPQCPAGANPNPIYQVL

SEQ ID NO: 290 - DNA, 1803 bp, Homo sapiens
aggggtgaggaagccctggggcgctgccgccgctttccttaaccacaaatcaggccggacaggagagggaggggtgggggacagtgggtgggcattcagactgccagcactttgctatctacagccggggctcccgagcggcagaaagttccggccactctctgccgcttgggttgggcgaagccaggaccgtgccgcgccaccgccaggatatggagctactgtcgccaccgctccgcgacgtagacctgacggcccccgacggctctctctgctcctttgccacaacggacgacttctatgacgacccgtgtttcgactccccggacctgcgcttcttcgaagacctggacccgcgcctgatgcacgtgggcgcgctcctgaaacccgaagagcactcgcacttccccgcggcggtgcacccggccccgggcgcacgtgaggacgagcatgtgcgcgcgcccagcgggcaccaccaggcgggccgctgcctactgtgggcctgcaaggcgtgcaagcgcaagaccaccaacgccgaccgccgcaaggccgccaccatgcgcgagcggcgccgcctgagcaaagtaaatgaggcctttgagacactcaagcgctgcacgtcgagcaatccaaaccagcggttgcccaaggtggagatcctgcgcaacgccatccgctatatcgagggcctgcaggctctgctgcgcgaccaggacgccgcgccccctggcgccgcagccgccttctatgcgccgggcccgctgcccccgggccgcggcggcgagcactacagcggcgactccgacgcgtccagcccgcgctccaactgctccgacggcatgatggactacagcggccccccgagcggcgcccggcggcggaactgctacgaaggcgcctactacaacgaggcgcccagcgaacccaggcccgggaagagtgcggcggtgtcgagcctagactgcctgtccagcatcgtggagcgcatctccaccgagagccctgcggcgcccgccctcctgctggcggacgtgccttctgagtcgcctccgcgcaggcaagaggctgccgcccccagcgagggagagagcagcggcgaccccacccagtcaccggacgccgccccgcagtgccctgcgggtgcgaaccccaacccgatataccaggtgctctgaggggatggtggccgcccacccgcccgagggatggtgcccctagggtccctcgcgcccaaaagattgaacttaaatgcccccctcccaacagcgctttaaaagcgacctctcttgaggtaggagaggcgggagaactgaagtttccgcccccgccccacagggcaaggacacagcgcggttttttccacgcagcacccttctcggagacccattgcgatggccgctccgtgttcctcggtgggccagagctgaaccttgaggggctaggttcagctttctcgcgccctcccccatgggggtgagaccctcgcagacctaagccctgccccgggatgcaccggttatttgggggggcgtgagacccagtgcactccggtcccaaatgtagcaggtgtaaccgtaacccacccccaacccgtttcccggttcaggaccactttttgtaatacttttgtaatctattcctgtaaataagagttgctttgccagagcaggagcccctggggctgtatttatctctgaggcatggtgtgtggtgctacagggaatttgtacgtttataccgcaggcgggcgagccgcgggcgctcgctcaggtgatcaaaataaaggcgctaatttataccgcc

SEQ ID NO: 291 - protein, 255 aa, Homo sapiens
MDVMDGCQFSPSEYFYDGSCIPSPEGEFGDEFVPRVAAFGAHKAELQGSDEDEHVRAPTGHHQAGHCLMWACKACKRKSTTMDRRKAATMRERRRLKKVNQAFETLKRCTTTNPNQRLPKVEILRNAIRYIESLQELLREQVENYYSLPGQSCSEPTSPTSNCSDGMPECNSPVWSRKSSTFDSIYCPDVSNVYATDKNSLSSLDCLSNIVDRITSSEQPGLPLQDLASLSPVASTDSQPATPGASSSRLIYHVL

SEQ ID NO: 292 - DNA, 1540 bp, Homo sapiens
acccaggccaacaggcgtctgcccttgttaattaccggagcgacagactagggagctccgcccgggatttgcccatcggcggaggcgccaggctcccgtttctccccatccctctcgctgccgtccaggtgcaccgcctgcctctcagcaggatggacgtgatggatggctgccagttctcaccttctgagtacttctacgacggctcctgcataccgtcccccgagggtgaatttggggacgagtttgtgccgcgagtggctgccttcggagcgcacaaagcagagctgcagggctcagatgaggacgagcacgtgcgagcgcctaccggccaccaccaggctggtcactgcctcatgtgggcctgcaaagcctgcaagaggaagtccaccaccatggatcggcggaaggcagccactatgcgcgagcggaggcgcctgaagaaggtcaaccaggctttcgaaaccctcaagaggtgtaccacgaccaaccccaaccagaggctgcccaaggtggagatcctcaggaatgccatccgctacatcgagagcctgcaggagttgctgagagagcaggtggagaactactatagcctgccgggacagagctgctcggagcccaccagccccacctccaactgctctgatggcatgcccgaatgtaacagtcctgtctggtccagaaagagcagtacttttgacagcatctactgtcctgatgtatcaaatgtatatgccacagataaaaactccttatccagcttggattgcttatccaacatagtggaccggatcacctcctcagagcaacctgggttgcctctccaggatctggcttctctctctccagttgccagcaccgattcacagcctgcaactccaggggcttctagttccaggcttatctatcatgtgctatgaactaattttctggtctatatgacttcttccaggagggcctaatacacaggaagaagaaggcttcaaaaagtcccaaaccaagacaacatgtacataaagatttcttttcagttgtaaatttgtaaagattaccttgccactttataagaaagtgtatttaactaaaaagtcatcattgcaaataatactttcttcttctttattattctttgcttagatattaatacatagttccagtaatactatttctgatagggggccattgattgagggtagcttgttgcaatgcttaacttatatatacatatatatatattataaatattgctcatcaaaatgtctctggtgtttagagctttatttttttctttaaaacattaaaacagctgagaatcagttaaatggaattttaaatatatttaactatttcttttctctttaatcctttagttatattgtattaaataaaaatataatactgcctaatgtatatattttgatcttttcttgtaagaaatgtatcttttaaatgtaagcacaaaatagtactttgtggatcatttcaagatataagaaattttggaaattccaccataaataaaattttttactacaagaaa

SEQ ID NO: 293 - protein, 224 aa, Homo sapiens
MELYETSPYFYQEPRFYDGENYLPVHLQGFEPPGYERTELTLSPEAPGPLEDKGLGTPEHCPGQCLPWACKVCKRKSVSVDRRRAATLREKRRLKKVNEAFEALKRSTLLNPNQRLPKVEILRSAIQYIERLQALLSSLNQEERDLRYRGGGGPQPGVPSECSSHSASCSPEWGSALEFSANPGDHLLTADPTDAHNLHSLTSIVDSITVEDVSVAFPDETMPN

SEQ ID NO: 294 - DNA, 1507 bp, Homo sapiens
gggctgctggagcttgggggctggtggcaggaacaagccttttccgaccccatggagctgtatgagacatccccctacttctaccaggaaccccgcttctatgatggggaaaactacctgcctgtccacctccagggcttcgaaccaccaggctacgagcggacggagctcaccctgagccccgaggccccagggccccttgaggacaaggggctggggacccccgagcactgtccaggccagtgcctgccgtgggcgtgtaaggtgtgtaagaggaagtcggtgtccgtggaccggcggcgggcggccacactgagggagaagcgcaggctcaagaaggtgaatgaggccttcgaggccctgaagagaagcaccctgctcaaccccaaccagcggctgcccaaggtggagatcctgcgcagtgccatccagtacatcgagcgcctccaggccctgctcagctccctcaaccaggaggagcgtgacctccgctaccggggcgggggcgggccccagccaggggtgcccagcgaatgcagctctcacagcgcctcctgcagtccagagtggggcagtgcactggagttcagcgccaacccaggggatcatctgctcacggctgaccctacagatgcccacaacctgcactccctcacctccatcgtggacagcatcacagtggaagatgtgtctgtggccttcccagatgaaaccatgcccaactgagattgtcttccaagccgggcatccttgcgagccccccaagctggccacagatgccactacttctgtagcaggggcctcctaagccaggctgccctgatgctaggaagccagctctggggtgccataggccagactatccccttcctcatccatgtaaggttaacccaccccccagcaagggactggacgccctcattcagctgcctccttagaggagagggcatcccctttccagggaggtaaagcaggggaccagagcgccccctcgtgtatgccccagctcagggggcaaactcaggagcttcctttttatcataacgcggcctctaattccaccccccaagtgaaacggtttgagagacgcagtgccctgacctggacaagctgtgcacgtctcctgttctggtctcttcccgatgccagtggctgggctgggcctgccctgaattgagagagaagaaggggagaggaacagccctctgttcccaagtccctggggggccaaacttttgcagtgaatattgggaaccttccagtggttttatgttttgttttgtttcgtgtgttgtttgtaaagctgccatccgaccaaggtctcctgtgctgaagttgccggggacaggcagggaaaaggggttggggcctcttgggggtgatttcttttgttaacaaagcattgtgtggttttgccattgttttgtattttttttttttttttttttttttgctaacttatttggatttccttttttaaaaaatgaataaagactggttgccagaa

SEQ ID NO: 295 - protein, 271 aa, Homo sapiens
MLQACKMEGFPLVPPQPSEDLVPYDTDLYQRQTHEYYPYLSSDGESHSDHYWDFHPHHVHSEFESFAENNFTELQSVQPPQLQQLYRHMELEQMHVLDTPMVPPHPSLGHQVSYLPRMCLQYPSLSPAQPSSDEEEGERQSPPLEVSDGEADGLEPGPGLLPGETGSKKKIRLYQFLLDLLRSGDMKDSIWWVDKDKGTFQFSSKHKEALAHRWGIQKGNRKKMTYQKMARALRNYGKTGEVKKVKKKLTYQFSGEVLGRGGLAERRHPPH

SEQ ID NO: 296 - DNA, 1377 bp, Homo sapiens
aaaatcaggaacttgtgctggccctgcaatgtcaagggagggggctcacccagggctcctgtagctcagggggcaggcctgagccctgcacccgccccacgaccgtccagcccctgacggggcaccccatcctgaggggctctgcattggcccccaccgaggcaggggatctgaccgactcggagcccggctggatgttacaggcgtgcaaaatggaagggtttcccctcgtcccccctcagccatcagaagacctggtgccctatgacacggatctataccaacgccaaacgcacgagtattacccctatctcagcagtgatggggagagccatagcgaccattactgggacttccacccccaccacgtgcacagcgagttcgagagcttcgccgagaacaacttcacggagctccagagcgtgcagcccccgcagctgcagcagctctaccgccacatggagctggagcagatgcacgtcctcgatacccccatggtgccaccccatcccagtcttggccaccaggtctcctacctgccccggatgtgcctccagtacccatccctgtccccagcccagcccagctcagatgaggaggagggcgagcggcagagccccccactggaggtgtctgacggcgaggcggatggcctggagcccgggcctgggctcctgcctggggagacaggcagcaagaagaagatccgcctgtaccagttcctgttggacctgctccgcagcggcgacatgaaggacagcatctggtgggtggacaaggacaagggcaccttccagttctcgtccaagcacaaggaggcgctggcgcaccgctggggcatccagaagggcaaccgcaagaagatgacctaccagaagatggcgcgcgcgctgcgcaactacggcaagacgggcgaggtcaagaaggtgaagaagaagctcacctaccagttcagcggcgaagtgctgggccgcgggggcctggccgagcggcgccacccgccccactgagcccgcagcccccgccgggccccgccaggcctccccgctggccatagcattaagccctcgcccggcccggacacagggaggacgctcccggggcccagaggcaggactgtggcgggccgggcctcgcctcacccgccccctccccccactccaggccccctccacatcccgcttcgcctccctccaggactccaccccggctcccggacgccagctgggcgtcagaccccaccggggcaaccttgcagaggacgacccggggtactgccttgggagtctcaagtccgtatgtaaatcagatctcccctctcacccctcccacccattaacctcctcccaaaaaacaagtaaagttattctcaatcca

SEQ ID NO: 297 - protein, 972 aa, Homo sapiens
MGPGVLLLLLVATAWHGQGIPVIEPSVPELVVKPGATVTLRCVGNGSVEWDGPPSPHWTLYSDGSSSILSTNNATFQNTGTYRCTEPGDPLGGSAAIHLYVKDPARPWNVLAQEVVVFEDQDALLPCLLTDPVLEAGVSLVRVRGRPLMRHTNYSFSPWHGFTIHRAKFIQSQDYQCSALMGGRKVMSISIRLKVQKVIPGPPALTLVPAELVRIRGEAAQIVCSASSVDVNFDVFLQHNNTKLAIPQQSDFHNNRYQKVLTLNLDQVDFQHAGNYSCVASNVQGKHSTSMFFRVVESAYLNLSSEQNLIQEVTVGEGLNLKVMVEAYPGLQGFNWTYLGPFSDHQPEPKLANATTKDTYRHTFTLSLPRLKPSEAGRYSFLARNPGGWRALTFELTLRYPPEVSVIWTFINGSGTLLCAASGYPQPNVTWLQCSGHTDRCDEAQVLQVWDDPYPEVLSQEPFHKVTVQSLLTVETLEHNQTYECRAHNSVGSGSWAFIPISAGAHTHPPDEFLFTPVVVACMSIMALLLLLLLLLLYKYKQKPKYQVRWKIIESYEGNSYTFIDPTQLPYNEKWEFPRNNLQFGKTLGAGAFGKVVEATAFGLGKEDAVLKVAVKMLKSTAHADEKEALMSELKIMSHLGQHENIVNLLGACTHGGPVLVITEYCCYGDLLNFLRRKAEAMLGPSLSPGQDPEGGVDYKNIHLEKKYVRRDSGFSSQGVDTYVEMRPVSTSSNDSFSEQDLDKEDGRPLELRDLLHFSSQVAQGMAFLASKNCIHRDVAARNVLLTNGHVAKIGDFGLARDIMNDSNYIVKGNARLPVKWMAPESIFDCVYTVQSDVWSYGILLWEIFSLGLNPYPGILVNSKFYKLVKDGYQMAQPAFAPKNIYSIMQACWALEPTHRPTFQQICSFLQEQAQEDRRERDYTNLPSSSRSGGSGSSSSELEEESSSEHLTCCEQGDIAQPLLQPNNYQFC

SEQ ID NO: 298 - DNA, 3820 bp, Homo sapiens
aaacagccagtgcagaggagaggaacgtgtgtccagtgtcccgatccctgcggagctagtagctgagagctctgtgccctgggcaccttgcagccctgcacctgcctgccacttccccaccgaggccatgggcccaggagttctgctgctcctgctggtggccacagcttggcatggtcagggaatcccagtgatagagcccagtgtccctgagctggtcgtgaagccaggagcaacggtgaccttgcgatgtgtgggcaatggcagcgtggaatgggatggccccccatcacctcactggaccctgtactctgatggctccagcagcatcctcagcaccaacaacgctaccttccaaaacacggggacctatcgctgcactgagcctggagaccccctgggaggcagcgccgccatccacctctatgtcaaagaccctgcccggccctggaacgtgctagcacaggaggtggtcgtgttcgaggaccaggacgcactactgccctgtctgctcacagacccggtgctggaagcaggcgtctcgctggtgcgtgtgcgtggccggcccctcatgcgccacaccaactactccttctcgccctggcatggcttcaccatccacagggccaagttcattcagagccaggactatcaatgcagtgccctgatgggtggcaggaaggtgatgtccatcagcatccggctgaaagtgcagaaagtcatcccagggcccccagccttgacactggtgcctgcagagctggtgcggattcgaggggaggctgcccagatcgtgtgctcagccagcagcgttgatgttaactttgatgtcttcctccaacacaacaacaccaagctcgcaatccctcaacaatctgactttcataataaccgttaccaaaaagtcctgaccctcaacctcgatcaagtagatttccaacatgccggcaactactcctgcgtggccagcaacgtgcagggcaagcactccacctccatgttcttccgggtggtagagagtgcctacttgaacttgagctctgagcagaacctcatccaggaggtgaccgtgggggaggggctcaacctcaaagtcatggtggaggcctacccaggcctgcaaggttttaactggacctacctgggacccttttctgaccaccagcctgagcccaagcttgctaatgctaccaccaaggacacatacaggcacaccttcaccctctctctgccccgcctgaagccctctgaggctggccgctactccttcctggccagaaacccaggaggctggagagctctgacgtttgagctcacccttcgataccccccagaggtaagcgtcatatggacattcatcaacggctctggcacccttttgtgtgctgcctctgggtacccccagcccaacgtgacatggctgcagtgcagtggccacactgataggtgtgatgaggcccaagtgctgcaggtctgggatgacccataccctgaggtcctgagccaggagcccttccacaaggtgacggtgcagagcctgctgactgttgagaccttagagcacaaccaaacctacgagtgcagggcccacaacagcgtggggagtggctcctgggccttcatacccatctctgcaggagcccacacgcatcccccggatgagttcctcttcacaccagtggtggtcgcctgcatgtccatcatggccttgctgctgctgctgctcctgctgctattgtacaagtataagcagaagcccaagtaccaggtccgctggaagatcatcgagagctatgagggcaacagttatactttcatcgaccccacgcagctgccttacaacgagaagtgggagttcccccggaacaacctgcagtttggtaagaccctcggagctggagcctttgggaaggtggtggaggccacggcctttggtctgggcaaggaggatgctgtcctgaaggtggctgtgaagatgctgaagtccacggcccatgctgatgagaaggaggccctcatgtccgagctgaagatcatgagccacctgggccagcacgagaacatcgtcaaccttctgggagcctgtacccatggaggccctgtactggtcatcacggagtactgttgctatggcgacctgctcaactttctgcgaaggaaggctgaggccatgctgggacccagcctgagccccggccaggaccccgagggaggcgtcgactataagaacatccacctcgagaagaaatatgtccgcagggacagtggcttctccagccagggtgtggacacctatgtggagatgaggcctgtctccacttcttcaaatgactccttctctgagcaagacctggacaaggaggatggacggcccctggagctccgggacctgcttcacttctccagccaagtagcccagggcatggccttcctcgcttccaagaattgcatccaccgggacgtggcagcgcgtaacgtgctgttgaccaatggtcatgtggccaagattggggacttcgggctggctagggacatcatgaatgactccaactacattgtcaagggcaatgcccgcctgcctgtgaagtggatggccccagagagcatctttgactgtgtctacacggttcagagcgacgtctggtcctatggcatcctcctctgggagatcttctcacttgggctgaatccctaccctggcatcctggtgaacagcaagttctataaactggtgaaggatggataccaaatggcccagcctgcatttgccccaaagaatatatacagcatcatgcaggcctgctgggccttggagcccacccacagacccaccttccagcagatctgctccttccttcaggagcaggcccaagaggacaggagagagcgggactataccaatctgccgagcagcagcagaagcggtggcagcggcagcagcagcagtgagctggaggaggagagctctagtgagcacctgacctgctgcgagcaaggggatatcgcccagcccttgctgcagcccaacaactatcagttctgctgaggagttgacgacagggagtaccactctcccctcccacaaacttcaactcctccatggatggggcgacacggggagaacatacaaactctgccttcggtcatttcactcaacagctcggcccagctctgaaacttgggaaggtgagggattcaggggaggtcagaggatcccacttcctgagcatgggccatcactgccagtcaggggctgggggctgagccctcacccccccctcccctactgttctcatggtgttggcctcgtgtttgctatgccaactagtagaaccttctttcctaatccccttatcttcatggaaatggactgactttatgcctatgaagtccccaggagctacactgatactgagaaaaccaggctctttggggctagacagactggcagagagtgagatctccctctctgagaggagcagcagatgctcacagaccacactcagctcaggccccttggagcaggatggctcctctaagaatctcacaggacctcttagtctctgccctatacgccgccttcactccacagcctcacccctcccacccccatactggtactgctgtaatgagccaagtggcagctaaaagttgggggtgttctgcccagtcccgtcattctgggctagaaggcaggggaccttggcatgtggctggccacaccaagcaggaagcacaaactcccccaagctgactcatcctaactaacagtcacgccgtgggatgtctctgtccacattaaactaacagcattaatgca

SEQ ID NO: 299 - protein, 304 aa, Homo sapiens
MITSETGKALIQTCLNSPDSPPRSDPTTDQRMSATGFEETDLTYQVSESDSSGETKDTLKPAFTVTNLPGTTSTIQTAPSTSTTMQVSSGPSFPITNYLAPVSASVSPSAVSSANGTVLKSTGSGPVSSGGLMQLPTSFTLMPGGAVAQQVPVQAIQVHQAPQQASPSRDSSTDLTQTSSSGTVTLPATIMTSSVPTTVGGHMMYPSPHAVMYAPTSGLGDGSLTVLNAFSQAPSTMQVSHSQVQEPGGVPQVFLTASSGTVQIPVSAVQLHQMAVIGQQAGSSSNLTELQVVNLDTAHSTKSE

SEQ ID NO: 300 - DNA, 3386 bp, Homo sapiens
gcagaggtgggagtgaccggcgccagagaggaagagggcccttgctgagtgaaggggcctatgagctgtccacgctgacagggacacaggtgctgttgctggtggccagtgagacaggccatgtgtatacctttgccacccgaaaactgcagcccatgatcaccagtgagaccggcaaggcactgattcagacctgcctcaactcgccagactctccaccccgttcagaccccacaacagaccagagaatgagtgccactggctttgaagagacagatctcacctaccaggtgtcggagtctgacagcagtggggagaccaaggacacactgaagccggcgttcacagtcaccaacctgccgggtacaacctccaccatccaaacagcacctagcacctctaccaccatgcaagtcagcagcggcccctcctttcccatcaccaactacctggcaccagtgtctgctagtgtcagccccagtgctgtcagcagtgccaatgggactgtgctgaagagtacaggcagcggccctgtctcctctgggggccttatgcagctgcctaccagcttcaccctcatgcctggtggggcagtggcccagcaggtcccagtgcaggccattcaagtgcaccaggccccacagcaagcgtctccctcccgtgacagcagcacagacctcacgcagacctcctccagcgggacagtgacgctgcccgccaccatcatgacgtcatccgtgcccacaactgtgggtggccacatgatgtaccctagcccgcatgcggtgatgtatgcccccacctcgggcctgggtgatggcagcctcaccgtgctgaatgccttctcccaggcaccatccaccatgcaggtgtcacacagccaggtccaggagccaggtggcgtcccccaggtgttcctgacagcatcatctgggacagtgcagatccctgtttcagcagttcagctccaccagatggctgtgatagggcagcaggccgggagcagcagcaacctcaccgagctacaggtggtgaacctggacaccgcccacagcaccaagagtgaatgatccgcccgccgccctggacagatggcccaagggatggcaccacttatttattgttgccttttcacgttttctttacacacacgttgacgggccgcaggagggaggcggggaggaggaacgggcagccacaggactgagccctctcactccagccaaagaaatgggcctgcctgcctccacccgtcctccctcagcctccccttcttcccgccccacctcccatttctgttgctggaggggctgtcctccttcctgggaccccctcgccagcttggctcgatgtttgccatgagtattagcttacccaatgggaccgtgccccacctccccacacacaggccttctgtggggctgggcaccgtgtcctcctctgaggaagcagttggggccctcttgccagcctccttgctgaccccaggtcagccctgtgtctgtcacaggctgggtcaaaagagccctggctctgcccctcagggggccagctggggagatgggggcttcttcctcacactgctgtcctctcccccttcagctcctgagtagctgggcctgtgcactgggcaggttcctggggccgcctgccctgccttgccgctccccttggacctccaggggctcctgggttggagggaaccaccagcgttcccttctcccccttgtcttcccccctctcctcccagctgctttacttaaagttgattttgaactttttatttgaggagacgaagtgaaaacaaatctataaatatatatttttaaaatatttaacttttttttatggcgtttttctcgtccccctccctgcccaaactccccttccctggggagccctcaggctccccagaactggctgggcccctggggacagagccaccccatgagctcggggtccaccagtgtgtgggggagattctgggtttgcccagtcctgggttgtttccaggagaaagccgggggaggggccctcaggccattccccaacggggtggggagggtgacccacagctctgggcctctttttgccctttagggctgttgctagggagagggaagagggagaccaaatgtcggggttggggtgggagggcgtcaggcagaggcaactgacttcatttgtgccacacgcatgggcattgcagccttgcgctgtcccaggcatgcagctgcctggggcccaagttgcagtgagcagggtggggtctgggagggggtgagaggcaggaatgggggtcagaagaagtgggagcagcttcttgggctgagtgcagccaaaggggagccagaaatgggcagttctcccagggagtgagcagctactgtaacttttttaaattaagacaaaaagccttgaagaaaatgactttatttttctaagtgtaacctcagtatttatgtaatttgtacaggggccatgccccacccccctcctccccctttggggtagaccttgagggtgggccagcataggggggagggtcttttaccctgtgtcagagcctaccttcaccacctatatccagaaggggagctttttcagaaacagggcagcagtggggtgaaattttcttaacccctaagactgccttcagtaggaacaagctggcttctgtgattaggtgaagggatgggggaagattttatgcacagcctagttatcaaggggatgatttgccgacatgtttgagaaccccctaacctctaaccctcattgctgtcttgccccagtttggggtgccaagatggaagtcacctttctgggctttctcctggagatagctggggcttatgggtggctttcaaggctggggcatggcaaatcaggggccagagagcaggggagcttgggactcaggtctgtaactgcccagccccttttctctgctcttgtttcactccaccatcactcactcactccccactcccccacccatggggaggagacctttgatgaattcttcctctccttcccacaaaagacagacccagtgagtgaatcaggcaaagtgcttataatgtgtgttgtgtgagcgtggccttgggaggacatgcgtgtgtcagggatgagttgaggtgatatttttatgtgcagcgacccttggtgtttcccttcctcggtggctctggggtatgtgtgtgtgggtgtgtgcgcctgagtgagtgtgtgtgcttgaatgtgagtgtgtatgtcagtggtttctacttcccctgggatgctgacccaggaatagtggacatggtcacagtcctatgtacagagctttcttttgtattaaaaaaaaatactctttcaataaatgtatcatttttgtgcacaga

SEQ ID NO: 301 - protein, 1586 aa, Homo sapiens
METSASATASEKQEAKSGILEAAGFPDPGKKASPLVVAAAAAAAVAAQGVPQHLLPPFHAPLPIDMRHQEGRYHYEPHSVHGVHGPPALSGSPVISDISLIRLSPHPAGPGESPFNAPHPYVNPHMEHYLRSVHSSPTLSMISAARGLSPADVAQEHLKERGLFGLPAPGTTPSDYYHQMTLVAGHPAPYGDLLMQSGGAASAPHLHDYLNPVDVSRFSSPRVTPRLSRKRALSISPLSDASLDLQRMIRTSPNSLVAYINNSRSSSAASGSYGHLSAGALSPAFTFPHPINPVAYQQILSQQRGLGSAFGHTPPLIQPSPTFLAQQPMALTSINATPTQLSSSSNCLSDTNQNKQSSESAVSSTVNPVAIHKRSKVKTEPEGLRPASPLALTQGQVSGHGSCGCALPLSQEQLADLKEDLDRDDCKQEAEVVIYETNCHWEDCTKEYDTQEQLVHHINNEHIHGEKKEFVCRWQACTREQKPFKAQYMLVVHMRRHTGEKPHKCTFEGCSKAYSRLENLKTHLRSHTGEKPYVCEHEGCNKAFSNASDRAKHQNRTHSNEKPYICKIPGCTKRYTDPSSLRKHVKTVHGPDAHVTKKQRNDVHLRTPLLKENGDSEAGTEPGGPESTEASSTSQAVEDCLHVRAIKTESSGLCQSSPGAQSSCSSEPSPLGSAPNNDSGVEMPGTGPGSLGDLTALDDTPPGADTSALAAPSAGGLQLRKHMTTMHRFEQLKKEKLKSLKDSCSWAGPTPHTRNTKLPPLPGSGSILENFSGSGGGGPAGLLPNPRLSELSASEVTMLSQLQERRDSSTSTVSSAYTVSRRSSGISPYFSSRRSSEASPLGAGRPHNASSADSYDPISTDASRRSSEASQCSGGSGLLNLTPAQQYSLRAKYAAATGGPPPTPLPGLERMSLRTRLALLDAPERTLPAGCPRPLGPRRGSDGPTYGHGHAGAAPAFPHEAPGGGARRASDPVRRPDALSLPRVQRFHSTHNVNPGPLPPCADRRGLRLQSHPSTDGGLARGAYSPRPPSISENVAMEAVAAGVDGAGPEADLGLPEDDLVLPDDVVQYIKAHASGALDEGTGQVYPTESTGFSDNPRLPSPGLHGQRRMVAADSNVGPSAPMLGGCQLGFGAPSSLNKNNMPVQWNEVSSGTVDALASQVKPPPFPQGNLAVVQQKPAFGQYPGYSPQGLQASPGGLDSTQPHLQPRSGAPSQGIPRVNYMQQLRQPVAGSQCPGMTTTMSPHACYGQVHPQLSPSTISGALNQFPQSCSNMPAKPGHLGHPQQTEVAPDPTTMGNRHRELGVPDSALAGVPPPHPVQSYPQQSHHLAASMSQEGYHQVPSLLPARQPGFMEPQTGPMGVATAGFGLVQPRPPLEPSPTGRHRGVRAVQQQLAYARATGHAMAAMPSSQETAEAVPKGAMGNMGSVPPQPPPQDAGGAPDHSMLYYYGQIHMYEQDGGLENLGSCQVMRSQPPQPQACQDSIQPQPLPSPGVNQVSSTVDSQLLEAPQIDFDAIMDDGDHSSLFSGALSPSLLHSLSQNSSRLTTPRNSLTLPSIPAGISNMAVGDMSSMLTSLAEESKFLNMMT

SEQ ID NO: 302 - DNA, 7187 bp, Homo sapiens
gctgatggattgcagaagtgccggcgcttgccagccgaggcagcacggctccgcggactttttttcaaactcccatcaatgagacttcgaggaggagcgggcggcggcggcggctgcgactgcgaacgcggaggaaggccaggagccgcaggaggagccggaggaaagagcttgggccgcgcggcgcgccgcagcctcggggagccgcctgctcgccggcggtaggggctgcgcggcgcccgcccgcctctcggtcccctctcttgcctggcccgccccgccccggctggctggagccccggcacaaggcagccagccgagggtcgccgcgccagccaaggtgggatgggggcccacagccaccgcccggcgcccgagaggccacctgcgtgctagaggcaaacttttgtctctctcggattgccacccaggacgatgagcggctgagatggagacgtctgcctcagccactgcctccgagaagcaagaagccaaaagtgggatcctggaggccgctggcttccccgacccgggtaaaaaggcctctcctttggtggtggctgcagcggcagcagcagcggtagctgcccaaggagtgccgcagcatctcttgccaccattccatgcgcccctaccgattgacatgcgacaccaggaaggaaggtaccattacgagcctcattctgtccacggtgtgcacgggccccctgccctcagcggcagccctgtcatctctgacatctccttgatccggctttccccgcacccggctggccctggggagtcccccttcaacgccccccacccgtacgtgaacccccacatggagcactacctccgttctgtgcacagcagccccacgctctccatgatctctgcagccaggggcctcagccccgctgatgtggcccaggagcaccttaaggagaggggactgtttggccttcctgctccaggcaccaccccctcagactattaccaccagatgaccctcgtggcaggccaccccgcgccctacggggacctgctgatgcagagcgggggcgctgccagcgcaccccatctccacgactacctcaaccccgtggacgtgtcccgtttctccagcccgcgggtgacgccccgcctgagccgcaagcgggcgctgtccatctccccactctcagacgccagcctggacctgcagcggatgatccgcacctcacccaactcgctagtggcctacatcaacaactcccgaagcagctcggcggccagcggttcctacgggcatctgtcagcgggtgccctcagcccagccttcaccttcccccaccccatcaaccccgtggcctaccagcagattctgagccagcagaggggtctggggtcagcctttggacacacaccacccctgatccagccctcacccaccttcctggcccagcagcccatggccctcacctccatcaatgccacgcccacccagctcagcagcagcagcaactgtctgagtgacaccaaccagaacaagcagagcagtgagtcggccgtcagcagcaccgtcaaccctgtcgccattcacaagcgcagcaaggtcaagaccgagcctgagggcctgcggccggcctcccctctggcgctgacgcagggccaggtgtctggacacggctcatgtgggtgtgcccttcccctctcccaggagcagctggctgacctcaaggaagatctggacagggatgactgtaagcaggaggctgaggtggtcatctatgagaccaactgccactgggaagactgcaccaaggagtacgacacccaggagcagctggtgcatcacatcaacaacgagcacatccacggggagaagaaggagtttgtgtgccgctggcaggcctgcacgcgggagcagaagcccttcaaggcgcagtacatgctggtggtgcacatgcggcgacacacgggcgagaagccccacaagtgcacgttcgagggctgctcgaaggcctactcccgcctggagaacctgaagacacacctgcggtcccacaccggggagaagccatatgtgtgtgagcacgagggctgcaacaaagccttctccaacgcctcggaccgcgccaagcaccagaatcgcacccactccaacgagaaaccctacatctgcaagatcccaggctgcaccaagagatacacagaccccagctctctccggaagcatgtgaaaacggtccacggcccagatgcccacgtcaccaagaagcagcgcaatgacgtgcacctccgcacaccgctgctcaaagagaatggggacagtgaggccggcacggagcctggcggcccagagagcaccgaggccagcagcaccagccaggccgtggaggactgcctgcacgtcagagccatcaagaccgagagctccgggctgtgtcagtccagccccggggcccagtcgtcctgcagcagcgagccctctcctctgggcagtgcccccaacaatgacagtggcgtggagatgccggggacggggcccgggagcctgggagacctgacggcactggatgacacacccccaggggccgacacctcagccctggctgccccctccgctggtggcctccagctgcgcaaacacatgaccaccatgcaccggttcgagcagctcaagaaggagaagctcaagtcactcaaggattcctgctcatgggccgggccgactccacacacgcggaacaccaagctgcctcccctcccgggaagtggctccatcctggaaaacttcagtggcagtgggggcggcgggcccgcggggctgctgccgaacccgcggctgtcggagctgtccgcgagcgaggtgaccatgctgagccagctgcaggagcgccgcgacagctccaccagcacggtcagctcggcctacaccgtgagccgccgctcctccggcatctccccctacttctccagccgccgctccagcgaggcctcgcccctgggcgccggccgcccgcacaacgcgagctccgctgactcctacgaccccatctccacggacgcgtcgcggcgctcgagcgaggccagccagtgcagcggcggctccgggctgctcaacctcacgccggcgcagcagtacagcctgcgggccaagtacgcggcagccactggcggccccccgcccactccgctgccgggcctggagcgcatgagcctgcggaccaggctggcgctgctggacgcgcccgagcgcacgctgcccgccggctgcccacgcccactggggccgcggcgtggcagcgacgggccgacctatggccacggccacgcgggggctgcgcccgccttcccccacgaggctccaggcggcggagccaggcgggccagcgaccctgtgcggcggcccgatgccctgtccctgccgcgggtgcagcgcttccacagcacccacaacgtgaaccccggcccgctgccgccctgtgccgacaggcgaggcctccgcctgcagagccacccgagcaccgacggcggcctggcccgcggcgcctactcgccccggccgcctagcatcagcgagaacgtggcgatggaggccgtggcggcaggagtggacggcgcggggcccgaggccgacctggggctgccggaggacgacctggtgcttccagacgacgtggtgcagtacatcaaggcgcacgccagtggcgctctggacgagggcaccgggcaggtgtatcccacggaaagcactggcttctctgacaaccccagactacccagcccggggctgcacggccagcgcaggatggtggctgcggactccaacgtgggcccctccgcccctatgctgggaggatgccagttaggctttggggcgccctccagcctgaacaaaaataacatgcctgtgcagtggaatgaggtgagctccggcaccgtagacgccctggccagccaggtgaagcctccaccctttcctcagggcaacctggcggtggtgcagcagaagcctgcctttggccagtacccgggctacagtccgcaaggcctacaggctagccctgggggcctggacagcacgcagccacacctgcagccccgcagcggagccccctcccagggcatccccagggtaaactacatgcagcagctgcgacagccagtggcaggcagccagtgtcctggcatgactaccactatgagcccccatgcctgctatggccaagtccacccccagctgagccccagcaccatcagtggggccctcaaccagttcccccaatcctgcagcaacatgccagccaagccagggcatctggggcaccctcagcagacagaagtggcacctgaccccaccacgatgggcaatcgccacagggaacttggggtccccgattcagccctggctggagtgccaccacctcacccagtccagagctacccacagcagagccatcacctggcagcctccatgagccaggagggctaccaccaggtccccagccttctgcctgcccgccagcctggcttcatggagccccaaacaggcccgatgggggtggctacagcaggctttggcctagtgcagccccggcctcccctcgagcccagccccactggccgccaccgtggggtacgtgctgtgcagcagcagctggcctacgccagggccacaggccatgccatggctgccatgccgtccagtcaggaaacagcagaggctgtgcccaagggagcgatgggcaacatggggtcggtgcctccccagccgcctccgcaggacgcaggtggggccccggaccacagcatgctctactactacggccagatccacatgtacgaacaggatggaggcctggagaacctcgggagctgccaggtcatgcggtcccagccaccacagccacaggcctgtcaggacagcatccagccccagcccttgccctcaccaggggtcaaccaggtgtccagcactgtggactcccagctcctggaggccccccagattgacttcgatgccatcatggatgatggcgatcactcgagtttgttctcgggtgctctgagccccagcctcctccacagcctctcccagaactcctcccgcctcaccaccccccgaaactccttgaccctgccctccatccccgcaggcatcagcaacatggctgtcggggacatgagctccatgctcaccagcctcgccgaggagagcaagttcctgaacatgatgacctagaggcccgagcgcctggtgctgagtgcacccggaggggtcatcgctgcccagagcctggggattccagctgtcttgtctttttccaaaaaagtgttaaataggcttgaggggttgttgcgcaatggccgcttcagatgacagatgttgtaagagaaggtttatgggcatcctctctggtcttttggattattcctcagaacaatgaaaaaagtctccataggacaggaaggaatgcaaaactcatttacacagtgctttccagcctttggtgcttacaggaccgcgctgttccggcttcttcacggctgacattcggctaacgagggattactttggccaaaacctttcaaaggatatgcagaaagatggtagggagcatttgggtttgaatctgaatgctatactggatactctgctccggaaagatgagctttttattctactacttggaaggaaaaggaattcctggtccacctgaattcctctatgaagcctaactcttgaggtctctaacataccttgtcatagaggaaaagcacagattatacctggatgattcaggagcacattctgattccaggtttggtagagctggctcttctactccgtaaagccgagtctgggactggcagcccatccaagtgtatatgaatgaataaagcatccaagtatatatgaatgaataaagtatgtaagtatcaccagaaaaaggaaagaaaaaatgtactccttggggcaagcccagaagctgccctggcctctccagaccgtgtttacagtgtttgcatgtagaatgtagcccttcctgaaaagaagacttgtttctaaatacctcggggctgctggagccgctgtgggttagggatggactgaggcctcgaggagtgagggtgcacccggggcccagcctcaggctgccctagggatctctcagtaggaagaggaagttgcgtgtttacccaatcctgtttctccaatgcaacgtccacccactttaccaccaaaaactccagggcctgacggcagcccggtcccccagcactcaccagcagcccagtgttctccaccaagccacagtgtgcatgcctggtatcctccggattcccttccttctgcccgctgagtcactgggcagagaatgatgacatgtgtaggtggtgtggttgggggtggaaaggggaaggggttgatcctcaggactctgagggagcatcgttgaattttcctgttcagtgtgaccaagacccacctggaaatggaatttggaactggcttcaggagacatcattcctgaacacactgtagggtgaattggtgcatcttccccaccatacacacacacacacacacacacacacacacacacacacacacaccccaaaccttttcatggggaatgtgtggcaaccttgccaaacagcaccactcagagtgtgactctgactgtgaccttggccttaatgaggaacttcttaggagagtttgaggacaaggccaacatcgtcatctgggctcgctgcgtcccagcacatcaaactctgtccagagacaaggccaactgcaaatgaaagccagggaacattgctaagggtctgtggctctgtggtggtgttcatcgccttcctgagataggatttcccttgccagtcccaacctgtatatattctgtacagaagacatccctgaatatactgtaggtgagtcgtccagccaaatttatatctccaaaacatttttagctttttctacatgctatgaattgagatgacatgctcaacttgtaaataagtctttttgtacattaaaaaagtaattttttcataatttatcttgtctatctgcttcccccttgacagtagttaatgagaacctgggcagtaaatttggtgcattcgagcagaaattaggctgtattttttcttaacagtgtcaaaattgactatcccgcctttgccaagaaatgtttaatgctgaggca

SEQ ID NO: 303 - protein, 767 aa, Homo sapiens
MATEGGKTSEPENNNKKPKTSGSQDSQPSPLALLAATCSKIGTPGENQATGQQQIIIDPSQGLVQLQNQPQQLELVTTQLAGNAWQLVASTPPASKENNVSQPASSSSSSSSSNNGSASPTKTKSGNSSTPGQFQVIQVQNPSGSVQYQVIPQLQTVEGQQIQINPTSSSSLQDLQGQIQLISAGNNQAILTAANRTASGNILAQNLANQTVPVQIRPGVSIPLQLQTLPGTQAQVVTTLPINIGGVTLALPVINNVAAGGGTGQVGQPAATADSGTSNGNQLVSTPTNTTTSASTMPESPSSSTTCTTTASTSLTSSDTLVSSADTGQYASTSASSSERTIEESQTPAATESEAQSSSQLQPNGMQNAQDQSNSLQQVQIVGQPILQQIQIQQPQQQIIQAIPPQSFQLQSGQTIQTIQQQPLQNVQLQAVNPTQVLIRAPTLTPSGQISWQTVQVQNIQSLSNLQVQNAGLSQQLTITPVSSSGGTTLAQIAPVAVAGAPITLNTAQLASVPNLQTVSVANLGAAGVQVQGVPVTITSVAGQQQGQDGVKVQQATIAPVTVAVGGIANATIGAVSPDQLTQVHLQQGQQTSDQEVQPGKRLRRVACSCPNCREGEGRGSNEPGKKKQHICHIEGCGKVYGKTSHLRAHLRWHTGERPFICNWMFCGKRFTRSDELQRHRRTHTGEKRFECPECSKRFMRSDHLSKHVKTHQNKKGGGTALAIVTSGELDSSVTEVLGSPRIVTVAAISQDSNPATPNVSTNMEEF

SEQ ID NO: 304 - DNA, 6072 bp, Homo sapiens
acagcccagcggcggccattcgcggaaaaagaggcagagcctgtgccagctacagcctcctccgagccaccgcgggcgggcgggaccggcctctcctcccgcctcgcccccacccccacccacctctatcccagtgtctccgtctgagggtttgtcctgttaatgcgggatgagcgaagaaggaggaggaggaggaggcggcagcggcagcggcgatggctacagaaggagggaaaacctctgagccagagaataacaataaaaaacccaaaacctcaggctcccaggactctcagccctctcctctggctttactggcagctacttgcagcaaaatagggactcctggtgaaaatcaagcaactggacaacaacaaattattatagatccaagtcaaggattggtgcaacttcaaaatcaaccacaacagctagaactggtaacaacgcaacttgctggaaacgcttggcaacttgttgcctccactcctcctgcttcaaaagagaataacgtttctcaaccagcctctagttcgtctagttcttccagcagtaataacgggagtgcatctcctacaaaaactaaatcaggtaattcttccacccctggtcaatttcaagtcatacaagtacaaaatccaagtggtagtgtacagtaccaagtaattccacaacttcagacagtggaaggtcaacaaattcaaatcaatccaactagtagttcatctctacaggatttgcagggtcaaattcagctcatttctgcaggtaataatcaagctatactcacagctgctaacaggacagcttctgggaatattcttgctcaaaacctggcaaatcagacagttccggtccaaattagacctggtgtttcaataccactgcagttacagactcttcctggtactcaggctcaagttgtaacaaccctaccaattaacattggaggagtgactctagctttgccagtgataaacaacgtggctgccggaggagggactgggcaggttggccagcctgctgctactgctgatagtgggacttccaatgggaatcaattagtttccacacccaccaacaccactacttctgccagtactatgccagaatctccctcctcctccactacctgcacaaccactgcttcaacgtctttgacaagcagtgacacattagtgagctcagcagatactggccagtatgcaagcacatcagccagtagttctgaacgcaccattgaagaatctcaaacacctgctgctactgagtctgaagcccagagctccagtcagcttcagcctaatggaatgcagaatgcacaggatcaatcaaattctcttcagcaggtgcaaattgtaggccaacctatcttacagcagatccagatccaacagcctcagcaacagatcattcaggctattccaccacagtcgtttcaactccagtcagggcagacgattcagaccatccagcagcagcctttacagaatgttcaacttcaagcagtaaatccgactcaggtgcttatcagggctccaactttaacaccttcagggcaaatcagttggcaaactgtacaggttcagaatattcagagtctttcaaatttgcaagttcagaatgctgggttatcccaacaattaaccatcaccccagtgtcttcaagtggtggcacaactcttgctcagattgctcctgtggctgttgctggtgccccaataactttgaatactgcccagcttgcatcagtgcctaaccttcagacagtgagcgttgccaacctgggtgctgcaggtgttcaagtgcagggagttcccgttacaatcactagtgttgcaggtcagcagcaaggacaagatggagtaaaagtccagcaagctactatagctcctgtaactgtagcagttggaggaattgctaatgccacgataggtgctgttagtcctgaccaactcacacaagtgcatttgcagcaaggccagcagacttctgatcaagaggtacaacctggcaagaggcttcgaagagttgcctgttcctgtcctaattgtagggaaggagaaggaagaggcagtaatgaaccaggaaaaaagaagcagcatatctgtcatattgaaggatgtggtaaagtttatggcaaaacatctcatttacgagcacatcttcgctggcatactggagaaagaccttttatatgcaactggatgttttgtggcaaaagattcacacggagtgatgagctccagagacatagaagaacccatacaggtgaaaagagatttgaatgcccggaatgttctaaaaggtttatgcggagtgatcatctctccaaacatgtcaaaacgcaccagaataaaaaaggtggtgggacagctcttgccattgttacctcgggagaactggactcatctgttacagaggtgcttggctccccaagaattgtcacagttgcagccatttctcaagattcgaatccagcaactcccaatgtttcaaccaacatggaagaattctgaaaagttatttataacagagacctctagtgctgcacttgtttacacacctttgaaaatctggaaatgggctggtcaagtggattacagagtaggaaattatgttttcattcttggcttctttaagtattccagggtttggggtcaacacgtgaagtgttgaattttaaaaaatacaaaaagcagactgatgtactggaaacagaaaagtatttcctccatactataagttgtagttgtttggaaatatatcacataacctttatacagaatcttcccatctcttaatatcatgtgttaacatgtttaaaaagaccttagtagtttgcaggctggaccttaattggacttattttctttgaaagtactttgttataaattcagtcagtaataatttacgtgtattctttttctctatagcacagaaaacagatagttaactgatgatagggataatactgtatttccttagcttgatttttggaaaatcaaccgaaaatagtttggccgtcttttctaaatgttagaaattcttcaacagttgaattaggtaagttccaaaacagtaatctgagatgcatctcagatctttattaccactacattatagtagtgtgtatgcagacaatcagtgaagtccaattactttctccatttggagacacaagaggaacatagagttaaatcttaggttaaattttaggttgacaccttaggaaaatgctgggaaaaaaatggttaaaacaaaactcatcatagcttcagaaaaataaaatgaggcatcttaacatgcaatgttctaaagttaggattgattatattcctaaccctaggttgaaccacaaaatttcatttaaaatgtttatatttggaaatatttgcatagagtgtaaattgttctgtagtttcatattttgtaaatatgagttatgttgacaatgtgcagaattctttatgctttgatgtggtagccaaagaaagaattacacttttttccaaggccagcagaaaattctcttttaactacattgtaattcttgttttcctctactaaaaattggccagtcccattttatttctagtgctatgtaagaaggtaattaggaattataacacagtaatgtttttatgttacatcaataactgaattttccctaaaaattagcctaatatataatagatatattatgaagcaaaacttttatttttgaaaaggcagaataattttcagtgaagtaagtgactaaagaaaaaaactatattattgtttatgcaagggtcttacaggaaagggtctttttttttttttttttgagatggagtctcgctctcttgcccaggctggagtgcaatggcacgatctcagcttactgcaaccgccgcctcccaggttcaagcgattctcctgtcttagcctcctgagtagctgggattaacaggcgcctgccaccatgcctggctaatttttgtatttttagtagagacagggtttcgccatgttggccaggctggtttcaaactcctgacctcaggtgatctgcccacctcggcctcccagagtgctgggattacaggcatgagccaccatgcccggctaggaaagggtcttactaggaaagatggccaaaagtttcatatgaaaaaaattggattataaaccagtaacttaaatattaataaggatattttatgttttaaaaaagtatttacacagaatcataatcagtgaaattgaccatttgaaaactaaaagtttttacctacctgctcaatttattaacatcattgctttggggactgtttgaatataggtacgtgttttcttgtgcattctctataatttcaggaaaagtactaatgcgaattctcttccaaaattgtgatgtttcttgtatttttgatgaaggagaaatactgtaatgatcactgtttacactatgtacactttaggccagccctttgtagcgttatataaaactgaaggtcttttgtgctttcagtttgtataaaaaagctttgagattaaaggaaaaaaaaaatttttacactgtggttataaatttcaagtttcttaaagcttttgtagacttgtaacagagtctttaaatttaagttggattttgtaaattgttttgtatattttatttaatgtactcttaacaactgatgtatctggctttaaaacatcagaattggtttgttgttttgtttggtacagaggagcatttggtagtgttcattttaattttattatataggagctgaaacatcaaatatatattttatctatcattatgctacacaatcagtgctataaatttttttatgcaaagaaactttcttaatgttttaatcatgtttcctcagagtgacactttttgttgttgttaataccaagtatgaacactctgcatcattattccatgaaccagttctaatgcaaacctatgtatgtccattagaaatggaagttattttttaatcaacaatgaggcctattataaatttatcagatgaatctagatagctttatagcatataaaatatgttaatttgtgttagcaggtgcacatttcaccactgaaattagaaatattttgacagtctgttctgcataccattctgagtctacttttctgtctttagaagaatcgtaaatttcagtgtcctttatttgactcagtgggatatagctgttataagtaatagggcacagatgtgcagtagagtcttgtttaatggcatttcactgttcattccctttaccaccgttataaaacttttctttattgtaattatcagtgcaaagctatgtatttatcatggtaaaactccagtgttagaatagttttttcttacagtatactttctttggttaggtttgtgtatgtgttgctgattacattagaacttgatgttaagtcatttatcacactctcatgagagcagtaataaaagtgtgtaatctaggagaaaaagttaatttgtcaaacttagataagcatgatgtttaggtcctatttttcaattttataactgttttattgcaacaatatttgtatttaagtctccattttaatgccttgtggtgtttttttatgcatgtcactaagttgtcatcccacataaattgatgtgcagcatagggtattaaatctacataatgattttaaaacagaaatagttgatggtaaaatgtaaatgttttgcaaaaattccttataaaaagttttgtagtaacatttcacttgtaaattttttttgtaaaaaaaaaaaaatgaaaaaaaaagatgaatccagaaaaaaacctgtttcccatattctagaatttagacaattattctgccagcaaagcctctggggctgtaattgacatttttacagtgctgatttgtataaaatttgttttttgtggatttggaaataaaatcatgtacaagttgttgcctgcaataacaattgcaagtaacctattaaaaattcccttgagtttaacatgtttcatttaattatgtatactataaagcagcaataaattatttgaactatcaaccta

SEQ ID NO: 305 - protein, 505 aa, Homo sapiens
MKFKLHVNSARQYKDLWNMSDDKPFLCTAPGCGQRFTNEDHLAVHKHKHEMTLKFGPARNDSVIVADQTPTPTRFLKNCEEVGLFNELASPFENEFKKASEDDIKKMPLDLSPLATPIIRSKIEEPSVVETTHQDSPLPHPESTTSDEKEVPLAQTAQPTSAIVRPASLQVPNVLLTSSDSSVIIQQAVPSPTSSTVITQAPSSNRPIVPVPGPFPLLLHLPNGQTMPVAIPASITSSNVHVPAAVPLVRPVTMVPSVPGIPGPSSPQPVQSEAKMRLKAALTQQHPPVTNGDTVKGHGSGLVRTQSEESRPQSLQQPATSTTETPASPAHTTPQTQSTSGRRRRAANEDPDEKRRKFLERNRAAASRCRQKRKVWVQSLEKKAEDLSSLNGQLQSEVTLLRNEVAQLKQLLLAHKDCPVTAMQKKSGYHTADKDDSSEDISVPSSPHTEAIQHSSVSTSNGVSSTSKAEAVATSVLTQMADQSTEPALSQIVMAPSSQSQPSGS

SEQ ID NO: 306 - DNA, 4199 bp, Homo sapiens
gtcagtccgatctcgcgagagaggacggaagcctgtgggagcccgtggcctttaaagtgccgttcagccttttcctccaggggtgctttgtaaacacggctgtgctcagggctcgcgggtgaccgaaaggatcatgaactagtgacctggaaagggtactagatggaaacttgagaaaggactgcttattgataacagctaaggtattcctggaagcagagtaaataaagctcatggcccaccagctagaaagatttcctgaagaggtagtctgattggcttaactcgtattcttgccatgagaaaaagaatgtgataagttattcaacttatgaaattcaagttacatgtgaattctgccaggcaatacaaggacctgtggaatatgagtgatgacaaaccctttctatgtactgcgcctggatgtggccagcgttttaccaacgaggatcatttggctgtccataaacataaacatgagatgacactgaaatttggtccagcacgtaatgacagtgtcattgtggctgatcagaccccaacaccaacaagattcttgaaaaactgtgaagaagtgggtttgtttaatgagttggcgagtccatttgagaatgaattcaagaaagcttcagaagatgacattaaaaaaatgcctctagatttatcccctcttgcaacacctatcataagaagcaaaattgaggagccttctgttgtagaaacaactcaccaggatagtcctttacctcacccagagtctactaccagtgatgagaaggaagtaccattggcacaaactgcacagcccacatcagctattgttcgtccagcatcattacaggttcccaatgtgctgcttacaagttctgactcaagtgtaattattcagcaggcagtaccttcaccaacctcaagtactgtaatcacccaggcaccatcctctaacaggccaattgtccctgtaccaggcccatttcctcttctgttacatcttcctaatggacaaaccatgcctgttgctattcctgcatcaattacaagttctaatgtgcatgttccagctgcagtcccactcgttcgaccagtcaccatggtgcctagtgttccaggaatcccaggtccttcctctccccaaccagtacagtcagaagcaaaaatgagattaaaagctgctttgacccagcaacatcctccagttaccaatggtgatactgtcaaaggtcatggtagcggattggttaggactcagtcagaggaatctcgaccgcagtcattacaacagccagccacatccactacagaaactccggcttctccagctcacacaactccacagacccaaagtacaagtggtcgtcggagaagagcagctaacgaagatcctgatgaaaaaaggagaaagtttttagagcgaaatagagcagcagcttcaagatgccgacaaaaaaggaaagtctgggttcagtctttagagaagaaagctgaagacttgagttcattaaatggtcagctgcagagtgaagtcaccctgctgagaaatgaagtggcacagctgaaacagcttcttctggctcataaagattgccctgtaaccgccatgcagaagaaatctggctatcatactgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggaccagagtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattttttttttttacttgaaattaaatttggctctaaagttggtgtagcagcagttgatcagactgaaaaacggtttttagtctctggaaaaagactgattttgctttttttataaatattattagatttattaatttttctgtgctcaatgtgtaaattgtattataattcattgtgatttatttcacttttaatttgctggtgttttaataaatgggggtgttactgaatctttcttcccacttccatttcttttgaccaccccttaaccctcaactgtgacggtagtagtattatcatttataccaaagttttgcatagtccctgttgactttgtaatgttaacggagtcataaaagcactaggcaagagaaagatagaaatttgcttttaatctttttgccttttattttgcacattatgcaaaaggaaaaacattaaagaacacttttttttaagtgagtgaaaacatggtaaagacatacagtgcttttatgcacattgttaagctaaatcaaggtcatttataatcattttccttttttatttaagattttaagtaaacaaattttagaattttcagcatttcaaaaatgattttatttttcaagtcttaaattcaatattttacacctatgttttgaggctaaaaatatgaaattatataatgtatgatacagggttatcaaatatctaataatttttgaaattagctcttgtttttggtttttttgttgttgtttttacagatttcaggttacaaactgcaaagtttatgcataattaagtatggtatggttgccagaaaagcctaaaattactacttagaaaatttaagactgtttacccccattgtcttgtacttgcgagctaacttgtactattcttgtgaaagcactgtcatcttttagtagcaaattttgataatgtttctcgtggaaaaaaaaatcagtatctatctttagaacaatgtaattataatgtgggaagtgtgcatgaatgagagagagtgtgtgtgtatctgtgtgtgtgtgcgcgtgtgtgtgtgtcttttaatagtttatgccagcaatctttgcttgaatgtttaacgatgccttcagtgtgatgctggccaatagatgattgcagtttaaaatgtcattattgtgcaggcttggataactaacattccatgatgtagcttgtttctgatgagatgattgtaggtacatttttctcattatccaatcatctgtgggatacttagttttctaatgtgccattatctatttttattctgcagttatgttcaaaatacagtacatattttaaaatagaataaattgttaaacataaaattttaaaagtagtagatgtgcgtaagaaaactttgtaaaatagttatgagtcctacccagtagcaacttctggcattcaagcaggattccactatgtaaatatctgtaatgcatttataataagttgtgtagtttgtcctgcatccatactacactatttgctaaagtctcagtgccatctcctaatgagactgacattttaaaagtctgtatggaatatccttgataattcaaggaaatatccctcctgcctaagttccaaactgggaaacattcaaattatataaatgacatttcaggactttaagtatgaagataatgggaattttattgttttgctttttaaaatgagagcatttttatttgataattttttttaaatttttaatttttaactaatttcattattttaaagtaatcagtttttcaaatcatgattttgatatcattattctaaggagttatctcaaaggcacaaaatatgaattctgcaagaaggctattttttattgtagtttgaatgggttaggaaaagcctcaatttttcactcttaagtccttcagtacatttttctttcatcttattacttatgcaagttaaggttctttggtaacagaattcttgcaactgtaaaataaaactacatagatgtaagaagtcatgtaaacggttaacaagcttaccaaggttagcaaaactttcattgtaaatcagtctgtactgagcaaataaaaatcattattagttgtataaacacaaattccattttgactttcaggatgtcatactacttctgtacctagcattttcagtccttatatttgcaatgttacacaaactgtactattttcttttatgtgcagtttgcatgagtaaaccatcagagaataaattctatctttaaatta

SEQ ID NO: 307 - protein, 181 aa, Homo sapiens
MMLQHPGQVSASEVSASAIVPCLSPPGSLVFEDFANLTPFVKEELRFAIQNKHLCHRMSSALESVTVSDRPLGVSITKAEVAPEEDERKKRRRERNKIAAAKCRNKKKEKTECLQKESEKLESVNAELKAQIEELKNEKQHLIYMLNLHRPTCIVRAQNGRTPEDERNLFIQQIKEGTLQS

SEQ ID NO: 308 - DNA, 1935 bp, Homo sapiens
ggcggaggtggggttagcttcagttgaccaaccatgccttgaggataaattggatgggatcagatgggaagatgtgacaagaagagaaatcctcctctatataggatgctctgctgtttcctaaggattttcagcaccttgccccaaaatcaaaatgatgcttcaacacccaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaagagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttatacccaaaaccctgaagccattggagagctgtcttcctgtgtacctctagaatcccagcagcagagaaccatcaaggcgggagggcctgcagtgattcagcaggcccttcccattctgccccagagtgggtcttggaccagggcaagtgcatctttgcctcaactccaggatttaggccttaacacactggccattcttatgttccagatggcccccagctggtgtcctgcccgcctttcatctggattctacaaaaaaccaggatgcccaccgttaggattcaggcagcagtgtctgtacctcgggtgggagggatggggccatctccttcaccgtggctaccattgtcactcgtaggggatgtggagtgagaacagcatttagtgaagttgtgcaacggccagggttgtgctttctagcaaatatgctgttatgtccagaaattgtgtgtgcaagaaaactaggcaatgtactcttccgatgtttgtgtcacacaacactgatgtgacttttatatgctttttctcagatctggtttctaagagttttggggggcggggctgtcaccacgtgcagtatctcaagatattcaggtggccagaagagcttgtcagcaagaggaggacagaattctcccagcgttaacacaaaatccatgggcagtatgatggcaggtcctctgttgcaaactcagttccaaagtcacaggaagaaagcagaaagttcaacttccaaagggttaggactctccactcaatgtcttaggtcaggagttgtgtctaggctggaagagccaaagaatattccattttcctttccttgtggttgaaaaccacagtcagtggagagatgtttggaaaccacagtcagtggagcctgggtggtacccaggctttagcattattggatgtcaatagcattgtttttgtcatgtagctgttttaagaaatctggcccagggtgtttgcagctgtgagaagtcactcacactggccacaaggacgctggctactgtctattaaaattctgatgtttctgtgaaattctcagagtgtttaattgtactcaatggtatcattacaattttctgtaagagaaaatattacttatttatcctagtattcctaacctgtcagaataataaatattggaaccaagacatggtaaacaaaaaaaaaaaaaa

SEQ ID NO: 309 - protein, 510 aa, Homo sapiens
MDGFYDQQVPFMVPGKSRSEECRGRPVIDRKRKFLDTDLAHDSEELFQDLSQLQEAWLAEAQVPDDEQFVPDFQSDNLVLHAPPPTKIKRELHSPSSELSSCSHEQALGANYGEKCLYNYCAYDRKPPSGFKPLTPPTTPLSPTHQNPLFPPPQATLPTSGHAPAAGPVQGVGPAPAPHSLPEPGPQQQTFAVPRPPHQPLQMPKMMPENQYPSEQRFQRQLSEPCHPFPPQPGVPGDNRPSYHRQMSEPIVPAAPPPPQGFKQEYHDPLYEHGVPGMPGPPAHGFQSPMGIKQEPRDYCVDSEVPNCQSSYMRGGYFSSSHEGFSYEKDPRLYFDDTCVVPERLEGKVKQEPTMYREGPPYQRRGSLQLWQFLVTLLDDPANAHFIAWTGRGMEFKLIEPEEVARRWGIQKNRPAMNYDKLSRSLRYYYEKGIMQKVAGERYVYKFVCDPDALFSMAFPDNQRPFLKAESECHLSEEDTLPLTHFEDSPAYLLDMDRCSSLPYAEGFAY

SEQ ID NO: 310 - DNA, 4082 bp, Homo sapiens
agagtccagccgctggtgcgcggagcggttcaccgtcttcggagcggttcggcccagcctttcgcccaggcgcccaggcccgctgcgcgcgtgcgtgagcgcgcctgcgccgccggggccgctgcaaggggaggagagaggccgcctcaggaggatcccttttcccccagaaattactcaatgctgaaacctctcaaagtggtattagagacgctgaaagcaccatggacgggttttatgatcagcaagtcccttttatggtcccagggaaatctcgatctgaggaatgcagagggcggcctgtgattgacagaaagaggaagtttttggacacagatctggctcacgattctgaagagctatttcaggatctcagtcaacttcaagaggcttggttagctgaagcacaagttcctgatgatgaacagtttgtcccagattttcagtctgataacctggtgcttcatgccccacctccaaccaagatcaaacgggagctgcacagcccctcctctgagctgtcgtcttgtagccatgagcaggctcttggtgctaactatggagaaaagtgcctctacaactattgtgcctatgataggaagcctccctctgggttcaagccattaacccctcctacaacccccctctcacccacccatcagaatcccctatttcccccacctcaggcaactctgcccacctcagggcatgcccctgcagctggcccagttcaaggtgtgggccccgcccccgccccccattcgcttccagagcctggaccacagcagcaaacatttgcggtcccccgaccaccacatcagcccctgcagatgccaaagatgatgcctgaaaaccagtatccatcagaacagagatttcagagacaactgtctgaaccctgccaccccttccctcctcagccaggagttcctggagataatcgccccagttaccatcggcaaatgtcagaacctattgtccctgcagctcccccgccccctcagggattcaaacaagaataccatgacccactctatgaacatggggtcccgggcatgccagggcccccagcacacgggttccagtcaccaatgggaatcaagcaggagcctcgggattactgcgtcgattcagaagtgcctaactgccagtcatcctacatgagagggggttatttctccagcagccatgaaggtttttcatatgaaaaagatccccgattatactttgacgacacttgtgttgtgcctgagagactggaaggcaaagtcaaacaggagcctaccatgtatcgagaggggcccccttaccagaggcgaggttcccttcagctgtggcagttcctggtcacccttcttgatgacccagccaatgcccacttcattgcctggacaggtcgaggcatggagttcaagctgatagaaccggaagaggttgctcggcgctggggcatccagaagaaccggccagccatgaactatgacaagctgagccgctctctccgctattactatgaaaagggcatcatgcagaaggtggctggagagcgatacgtctacaaatttgtctgtgacccagatgccctcttctccatggctttcccggataaccagcgtccgttcctgaaggcagagtccgagtgccacctcagcgaggaggacaccctgccgctgacccactttgaagacagccccgcttacctcctggacatggaccgctgcagcagcctcccctatgccgaaggctttgcttactaagtttctgagtggcggagtggccaaaccctagagctagcagttcccattcaggcaaacaagggcagtggttttgtttgtgtttttggttgttcctaaagcttgccctttgagtattatctggagaacccaagctgtctctggattggcacccttaaagacagatacattggctggggagtgggaacagggaggggcagaaaaccaccaaaaggccagtgcctcaactcttgattctgatgaggtttctgggaagagatcaaaatggagtctccttaccatggacaatacatgcaaagcaatatcttgttcaggttagtacccgcaaaacgggacatagtatgtgacaatctgcatcgatcatggactactaaatgcctttacatagaagggctctgatttgcacaatttgttgaaaaatcacaaacccatagaaaagtaagtaggctaagttggggaggctcaaaccattaagggttaaaaatacatcttaaacattggaaagctcttctagctgaatctgaaatattaccccttgtctagaaaaaggggggcagtcagaacagctgttccccactccgtggttctcaaaatcataaaccatggctactcttgggaaccacccggccatgtggtcgccaagtagagcaagccccctttctcttcccaatcacgtggctgagtgtggatgacttttattttaggagaagggcgattaacacttttgacagtattttgttttgccctgatttgggggattgttttgttttggtggttgttttggaaaaacagtttataaactgatttttgtagttttggtatttaaagcaaaaaaacgaaaaacaaaaaacaaaaacaaaccttttggtaactgtgcactgtgtcctttagccagggccgtgccaacttatgaagacactgcagcttgagaggggctttgctgaggcttccccttggccatgtgaaagcccgccttgttgcctgctttgtgctttctgcaccagacaacctgatggaacatttgcacctgagttgtacatttttgaagtgtgcagggcagcctggacacaagcttagattctctatgtatagttccccgtgttcactaacatgccctctctggaaagcatatgtatataacatgtgtcatgtcctttggaaacctggtcacctggtgaaaacccttgggattcttccctgggcatgactgatgacaatttccatttcatcagtttgttttgttttcctttttctttaaatcttggactttaaaccctacctgtgtgattcagtagggtttgagacttacgtgtgatactgacaggtaagcaacagtgctagcattctagattcctgcctttttttaaaaagaaattattctcattgctgtattatattggaaaagttttaaacaaccaagctaaagctatgtgaaagttgagctcaaagtagaggaaaagttactggtggtaccttgctgcctgctctgctggtagaattctgtgctccccgtgacacttagtacattaagaatgactacactgttcctcgtatgtgaaggaggcagtgctgactccgtgagtgtgagacacgtgctttgaactgcttttctattcatggagcactccatagtctcaaactgtcccccttatgaccaacagcacatttgtgaagaggttcgcagggataaggggtgcactttatagctatggaaacatgagattctcctctattggaagctaattagcccacaaaggtggtaaacctgtagattgggccttaattagcattgtactctaatcaaaggactctttctaaaccatatttatagctttcttaacctacacatagtctatacatagatgcatattttacccccagctggctagagatttatttgttgtaaatgctgtatagatttggttttcctttctttacttaccctggtttggattttttttttttttcttttgaatggatttatgctgtcttagcaatatgacaataatcctctgtagcttgagctacccctcccctgctgtaacttacgtgacctgtgctgtcactgggcataggacagcggcatcacggttgcattcccattggactcatgcacctcccggatggtttttgtttttttcgggggttctttggggtttgtttgtttgcttcttttccagagtgtggaaagtctacagtgcagaaaggcttgaacctgccagctgatttgaaatactttcccctgcgcagggccgtatgcatcctgccaagctgcgttatattctgtactgtgtacaataaagaagtttgcttttcgtttaccaagca

What is claimed is:

1. A method for treating a musculoskeletal disease intervertebral disc (IVD) degeneration in a mammalian subject, comprising injecting into the IVD of the mammalian subject (a) a first extracellular vesicle produced from a donor cell containing or expressing T-box family protein and a Forkhead-box (FOX) family protein;

(b) a second extracellular vesicle produced from a cell containing or expressing a Mohawk family protein and Scleraxis.

2. The method of claim 1, wherein the first extracellular vesicle is produced from a cell containing or expressing a T-box family protein, a SOX family protein, and a Forkhead box (FOX) FOX family protein.

3. The method of claim 1, wherein the first extracellular vesicle is produced from a cell comprising a polynucleotide comprising FOXF1, Brachyury, and Sox9 genes operably linked to an expression control sequence.

4. The method of claim 3, wherein the second extracellular vesicle is produced from a cell comprising a polynucleotide comprising Mohawk and Scleraxis genes operably linked to an expression control sequence.

5. The method of claim 1, wherein the T-box family protein is Brachyury.

6. The method of claim 1, wherein the donor cell is a musculoskeletal cell or skin cell.

7. The method of claim 1, wherein the donor cell is a nucleus pulposus (NP) cell, annulus fibrosis (AF) cell, cartilage endplate cell, articular chondrocyte, tenocyte, or osteoblast.

* * * * *